United States Patent 10,767,156 (POLYNUCLEOTIDES ENCODING BREX SYSTEM POLYPEPTIDES AND METHODS OF USING SAME) - sequence listing, part 3

SEQ ID NO: 2 - DNA, 3005051 bp, Lactobacillus rhamnosus (residues 1-1,502,526 of 3,005,051)
atgcccaatttagaggagctttgggcttacctgaatgataaattccgtgaagagttgaccccagtcggttacagcacatggattcaaacagccaagccggtcaaattgacccaagataaactcgaaatcgaagtacctgcatctttgcacaaggcctactgggagaaaaatctggttaccaaagtggtggaaggcgtctatgagtttgcccaattagaagtcgatcctgtcatcatgaccaaagacgagttgcagcccgcttccacgcatcagcatcaagtaaccgatgacgatgatgaccaacaactcacctttaaggcaaaaacgcatttaaatccgaaatatacttttgaccgcttcgtgattggtaaaggtaaccaaatggctcacgcggcggctttagcagtagctgaggcgcctggtacgacttacaacccgctgtttatttacggcggcgttggcttggggaagacgcatttgatgcaggcgatcgggaatctggtcttggaaaataatcccgctgccaacattaaatatgtcaccagcgagaattttgccaatgacttcattaattccatccaaacaaaacagcaagaacaatttcgtcaagagtaccgaaatgttgacttgctgttggttgatgatatccaattcttcggtgacaaagaagccacgcaagaagagttcttccatacatttaatacattgtacgaaaatatgaagcaaattgtcctaaccagtgatcgtctgcctaatgagattcccaagttgcaggaacgtctggtatcccgcttcaataaaggactatccgttgacgtcaccccgccggatcttgaaacccgtatcgccatcttacgcaataaagccaatgcagaagatctcagtattccggatgacacgctttcttacattgctgggcaaattgaaagtaacgtccgtgatcttgaaggggcgctggttcgggttcaggctttttcaacgatgaagaacgaggacatcacaaccagtttagcggcagatgcactaaaagcccttaaactcgatgatcgtagcggacaactcaccattccgcagattctcgatgcggtcgccaaatattttcaagtcaccgttcaggatctaaaaggcaaaaagcgggttaaacaaattgtcattccccggcaaatcgccatgtacttagcacgcgagatgaccgacaatagcttaccgaaaatcggccaggaaattggcggaaaagatcacacgactgtcattcacgcccacgaaaaaatcatggctgccatgaccaccaacgaagatttaaaagcacatgtggtcgaactccgcaatatcctgaaaaatcgtggttaatccacttgtggacaactgccagaaacagaactttttgtccctatcacttatccacaggtgcataacttcatgatttgctgttccgcaaagttatccacagtttgaacacgccctattactattactctaaaagctttatattatatatataaaacgacgtacaggaggctcttatgaaatttacgattacccgatccacattcttgaaaaccttgaatgatgtttcccgggctatttcaaccaaaaccacgatcccgattttgacagggttaaaaatcgtgctcaatgatactggactagtgctgaccggtagtgatgctgacatttcgattgagtcaaccattaacgctgctgatgaaagtaacgatttacaaatcggcagcactggtgaaattgtgttaccagcgcgcttcttcagcgaaatcgttaaacggctgccagaaagcaccatgacagtagaagtaaaggacaattttcagacggtcattacttcaggagcttccgagtttacgattcgtggagaagatgcgaacaattatccgcgtctaccggaaattaccgcagatgaagccttatctgttccggctgatgtcttacgccaactgattaaccaaaccgttatcgccgtatccaatcaggaaagtcggccaattctgaccggggtgcatttaacgattaccggcgatcaactcgttgccgttgcgaccgattcgcatcggttatcgcaacgtactctgacattaccagcagcaagtaatatcgattacgacatcatcattcccggtaaaagtctgacagaactaagtcgcatgttaggtgacgatgtgactaaaatcgaaattcgcattgccgagaatcaggtattatttgtatttggacaaaccgccttttattcgcggttgcttgaaggcaattatccagacacaagtcgacttatcccaacgtccagcaatacgcaagccgaattcgatgcgccggcactgctggcttccattcagcgggcgagcttgctgagtcacgaaagcagcaataacgtggtgcgtttagtcctcaacattggcgagcaaagagcaaccatctatggtaattcgccagatgtcgggaatgtcgaagaagtcttaagctttaacaagctgaccggtcaggatctggaaatctccttcaaccctgattacatgaaggacgcgctgcaaggctttggccaaacagcgattgaagttgactttacggcaccgctgcggccattcaccttggttccaaccgaagataaagagaagtttattcagttgattacgccggtgcggacgttctaagcaatagaaaaacgcaaatacagagccaattaaaaaagattctagagcgcggtgaaaagctctggaatcttttttattgctttcaacgctgtgatcaaggtcggtgtgttgtatttcaacaggtaatcatcaaccgaccaaaatgctttgacaagttgatccataccaaggtgttatacccagaatcacgctaaccattagcgtatcaaatatattcctgcaactctgagtgtcagctcgagacacttatcacctaaaaacggctttaggctaggctaaaaacgataaaactaaaaatttggctgtttttgggctttctaagtgtttttagtctaggggggcgtcttaggctcaaattgcctcagagccgcttaaatgcccgttttgaattgttttttacttggtataagggtataattaatttgtgttcgttagcggcaaatcaccgtttctggtggtttgccgatacatttcggattggagggcgacgacgatgacaaccatcaagatcaccaccgcatttttgacattgggccagtttctgaaagaggcaggtttgattgatagcggcggtgcggctaagtggtatttgggtgagcacccggtaaccgtgaacggggcagctgaagaccgtcgtggccggaagctgtatccgcatgatcagattaaagttgccgatcagacctatgtgatcgtgagcgcatgaagctggatcatttaacgttaaaaaactatcgcaattacgcaacggtcgatacggcattttcaccggagatcaatgttttgatcggtgaaaatgcgcaaggcaagacgaatctgcttgaagcgatttatgtattggcgttagcgcgcagccatcggaccaacaatgataaagagttgattcgctttggcagtgattttgcgcgcgtctccggtcagatcagtcgccaaagcgggacgcatcagctggaattaattattagtcatcaaggtaagcgggcgcggattgatcggatcgaacagtcaaaactgtcgcaatacttagggcattttaatgtcattttgtttgcaccggaagatttggcgattgtcaaaggcagtccggctgggcggcgacggtttatcgacatggaatttggccagatgagtcccaagtatctttataatctgagccaatacaaaacgtttctaaaacagcgaaacgcatacttaaaacagctgaaataccatcaagccaaggatcttgtgtatttagacgttttgactgattcgttggcggcgtttggagccgagctgatcacggcgcgggcaaaattgctgcagaccatgtcggattatgcggctgccattcaacaagacattaccaagggacgcgaaaagttgcagtttgcttatcagactcaggttgctgcggatcttcgacaagatagtgaacaagtctatgaagcattaggtgccttgtttgcaaagcagcagtcgcgggaaatcgagcaaggcaccagtttggtcgggccgcatcgcgatgatgttttgtttattgtcaatgataaggatgttgctaatttcggtagccaaggccagcagcgcaccacggctttggcagttaagttagccgaaatcgacttaatgaaggatcagacaggcgaatatccggttttgttactggatgatgttttgtctgaacttgacgctattcgccagacccatttattgaaggccattcaagccaaggttcagacgtttctgacaacgaccagtctggatggcattcaaaaggaaatcatcacggcgcccgctatttttcaggtgcaggatggcgttttgacgaagcaggcgtgagcaactgtaaacgatacgaggaggataaccagtgacggacaagaaagaatcggccgaagaaaagaaagaagaactggcagcagaatatgatgctagtcaaattcaggtgctgtcaggactcgaagcggttcgcaagcgcccaggaatgtacatcggctcaactagcagtcaaggattgcatcatttagtttgggaaatcattgataacgggattgacgaagcgttggctgggtttgcaacgcgaattgaagttgaagtcaacccggataacagtgtgaccgttaccgatgatggccgcgggattcctgtcgacattcaggcaaaaaccggtcgtccggcacttgagacggtttatacggttttgcatgccggtggtaagtttggcggtggcggctataaggtctccggcggtttgcatggtgtcggcgcttcggttgtcaatgcgctatcaacgaatctggatgtgacggttgttcgcggcggcaagcggtattacatcgactttgtgcgcggcaaggttaacacgccgatgaaagaacttggcccggcaccggagcatgagcatgggaccaaggtccattttcagccggatccggatattttcacggaaaccacaacgtttgatgataaagtcctgacaacgcggattcgtgagttggcctttttgaataaggggcttaagctgacgtttactgataagcgtgcggcgactcatgaaaagctggtgtttcattatgaaggcggcttgaaatcttatgttgatttcctgacgaagaagaaagaaaacctgctgcaggaaccgatttatgtggaaggtcaggataaaggcattacggttgaagtcgcgctgcagtatacgaatgactatcacagcacgctgttgacgtttgccaataacattcacacttacgaaggcggcacgcacgaaaccgggtttaagacggccttgacgcgggtgattaatgattatgcccggcgttccggtgcacttaaagacagcgatgatccgctcagtggggatgacgttcgggaaggcttaaccgcagttgtttcggtcaagcatcctgatccgcagtttgaaggccagaccaagaccaaactggggaactcggatgcccgcacggtggttgatcgtaccttctccgatcacttcaataaatttcttatggaacatccggctgacggcaagctcattattgacaaggccatgcttgccagcaaagctcgcttagctgctaaacgggcgcgtgaagtaacgcgtaagaagagcggcttggaaatctccaatctgccagggaagttagctgacaacaccagtaaagatccggaaatttccgaattgttcattgtcgaaggggattccgcgggcggttcggctaagtcgggacgcagccggctgacccaagcgattttgccaattcgcgggaagattctgaatgttgaaaaagcatccatggaacgtattttggccaacgaagaaatcagaacgttattcacggcgatgggcaccggttttggtcaggactttgacattagcaaggcccgttatcacaagttgatcatcatgaccgatgccgatgtcgatggcgcccatattcggacgttgttgctgacgctgatttatcgctacatgcggccggtgcttgatgctggctacgtgtacatcgcccagccgccgttgtatcgcctgcgtcaaggtaaaatgatgcgttacatcgattccgatgaagagctacaggatattctggggcaactgccgcctagtccgaagccggatattcaacggtacaaagggcttggtgaaatggacgccagccagctttgggaaaccaccatggatcctgacacgcgccggcttttacgggtatcgccaaaagatgctgaacaagcagatggcatttttgaaatgctgatgggcgatcatgttgagccgcggcggaagtttatcgaagaaaatgcggtctttgttgatccgaacaacattgacgtatgatagatcgcttttaggatgcagacaggtaaaatgagaacttttgagaggagacttttcgcttaatggatgatcgccaagaaagccggattacgaatgtgaatctcggcgaaacaatgcgtaaatcattccttgaatacgcgatgagtgtcattgtggcgcgggcattgcctgacgtacgtgatggcctcaaaccggttcagcgccggattctgtatggcatgaatgaactcggggtcacaccggataagccatacaagaagagtgcgcggatcgtcggggatgtcatggggaagtaccatccgcatggtgacagctcgatttatgaaggactcgtccgaatggcgcaggactttagttaccggtatatgctggttgacggccacgggaactttggctcggttgacggtgacggtgcggcggcgatgcgttacaccgaagcccggatgagtaaaattgccgtcgaaatgttacgcgacatcaacaaagacacgattgattttcaggataattacgatggcaccgaaaaagaaccggttgttttgccagcgcgcttcccgaatctgctggtcaacggtgcgacagggattgcggttgggatgaccaccaatattccgccgcataatctgtcggaaacgatttcggccttgcatgtgctgatggatcatcctgatgccaccaccgctgacttgatgcaggcattgccgggacccgattttccaaccggtggcgttgtcatgggcaagtccggtattcgccacgcatacgaaaccggtcgcggaacgattgtgttgcgtggtaaagtcgacgttcaaactgaaaagtccgggcgcgaacggatcgttattaccgaaattccatacatggttaacaaagccaagatggtggaacgaattgccgatttggtccatgaaaagaaaattgacggcattgtcaccttgcgtgatgaatccgatcgtgatgggatgcggattgtcattgatgtccgccgcgatgccagtgcttcggttattttgaataatctctacaaactgacaccgctgcaaaccggtttttccttcaacatggtggcgattgtcaatggtgcgccaaaggtattgagcctgaaacagatcctgcaatattatctggatcaccaggaaaatgtcattcggcggcggacgcaatatgacctgaagaaggccaaggcacgggaacatattcttgaaggcttgcgaattgcgcttgatcatatcgatgaaatcattacgattattcgcagttccgaaaccggcgataaagctaaagtcatcttaatggacaagttcaatctgtccgataagcaaagtcaggccatcctggacatgcggctggtgcggttgaccggtctggaacgtgacaaggttgaaagcgagtataaagatgtggaggcagccattgccgactacaccgatattctggctaaaccggaacgtgttcaccagattatttatgatgaattgctcgatattcaaaagaaattcggtgacaagcgccggactgaactgctggtcggtgaagtgctgagtcttgaagatgaagatctgattgagcaagaagatgtcgtgattaccttgagtcacaacggttacgttaagcgcttggcaaccagtgaattcaagacgcaaaatcgcggtggtcgcggtattcaagggatgaacgtccatgacgatgatttcgtcgaacacctgatttccacgtcaacccatgatgttttgctcttcttcaccaacaaaggcaaagtttaccgcagcaagggttatgagattccagaatacagccggacagcaaaagggatcccgatcattaacctgttaggtgttggcgcgggcgaaaagattcagacagtgatcaacgtccacgaaggcgacaatgatgatcgctatttattcttcgtcacccaaaacggtgtagttaaacggacaccggtcaaggaatttgccaatatccgcagcaacggtctgattgcgctcaacttgaaagatcaagatgaattgaacaatgtcattttgacgtctgggcaggataacatcttgatcggcacgcacttgggttacagtgtggcctttaaggaacaggatgttcggtcaatgggtcggacagccaccggggttcgcggcattcgccttcgtgatcacgattacgtggttggctccgatatccttaagccagattccgaagtctttgttatttccgaaaaaggctacggtaagcgcacagctgccaaggaatatccgattaagggtcgcggcggtaaagggattaagaccgcgaatattactgagaagaatggtccgctggcaggggttacgacagttgacggcaccgaagatattctggtgatgacagactctggggtcatgattcgcttcaatatccaaaatgtgtcgcaaaccggccgggcaacactaggcgttcggttgattcgggtcgacgatgatgccaaggttgcaaccatggctaaggtcgaaccggaaagcgacgatccagatgacagcagcaaaccggatcagccaaccgatccgcaagccggaccaactgatgcacatgcgcaaccggctgacgggcagtatgcaggcaatgccgatgaacaggttaacaaactgttagatcgttcggagactgataaacctgcacctgatgatggcgatgaagcctaactgaaccaagatgcgttgaagcgtcaatgaaaataccgttcgaatgggtagtttgccagttcgaacggtatttttgtgcctcgtttttcacgcggctcgtagcttgctccccaaaatttttgatcgctaatccatttacgttaaacatcatagttttgacataatgtatagcagacagtgaaaaatagagcgatgagatttgaggggaagagttatcatgttaaacaatgtgagtttaaccggccgtctgacgaaggaaccagaagtgtttaaaactgctgctgatttggaaccagtgcgctttacgttggtagtgtgagcaattttagttgaaaagcacaaaataaatataatgatttttagttattttttcttttaaccatatgataaaacaccgctgcagcgattccacctatcataaggctaacaacgagcgcaacagggtttaaccagttgtttggactgacgaagatgttaccatataaatagatcaggattgaaaataaaataaatataccaataacggaatttttgttttttgcatttttcatagtgtttaatctcccttattagactgtaatatgtattataaagatttttttggaaagaaaagcgtttacaatattttattaagatgttagattaatacataggaaaactagttttctaaaaaataaagaaatggagcgaatatgatgacgacaactcttagtttgtacgatgccttaggtgaggatcaactccaaggtatcaatggtggccgtggtaaatgctcagcgaacgaagctaataaagcaatgggaaatgcttttgttggcgggttcgttggtggacttcccggtggattcctcaccgctctgggcgcaggtggagcaggtggtttagctacgggagcgggttactgggcgacatgctggtggtaaggtagtagacctgccggatgcgaaaaagctgacacgtatttgtgtcagcttttttagaagaatgattaaaaaattcaaaaggagtgaaactcaaatgaaaaaaatcattaaacttgcaatggctggatttatcggaataataacctttactctactgttgaatcctataagggtatctgcacacgaagatgccgacataccccaggtaacagaaaaagaatatttaaacaatataaatggtgtgaagcagattgactctgatcagtacttggaattagtcaatagtggggatgcttcttctgattttgtcgtttattttggttttaaggagtgcccatactgtcgagcagtttctcgtacgctgaagcagtttataagtgaggctaagcacccaatatactatatgaatatggacgagagtttcacggagacgacagctgatgactataaacaaattctggaatcactcagtccgtttaagtttcatggaacaccaactttcgcttatttccataataacaagatacgtaatatgttagttggatatccaattacacttcagcaattcacgcaaacagaagtaagcgttctgaataagcaacaataattatgctgggtggtatgaaaggctcactggaaatatagattttgacattgacttttgttttcttgattatttaggttctcagttggtctcaagatctgtgctaaggttattgcttaattctttagaaccgtttcaaaactacgtgggttgcatcagcatgtaaattagtatggtcaatcatgcgactgaattgatctaacgtataagcgggcatcgtaatccctccaaaaattgaattcgcttacatccagcatagcacgttttgcgtaatgtatagcagacagtgaaaaatagcacgatgagatttgagggggagagttatcatgttaaacaatgtgagtttaaccggccgtctgacgaaggaaccagaagtgtttaaaactgctgctgatttggaactagtacgctttacgttagcggtggatcgggtttttaaaagtaaaaccggacaacgggaaaccgattttattgagtgcgtgatctttggcaaacgcgcactgacatttgccagctcgacaacaaaaggctcgttgatcgggattgccggccgaatcagcaataatcatttcgagaataaacaaggcgaacagcagtggcggacttcggtagtcgtcgataattttgcctggctggagtcgcgtgccatgaccgagagtcggcgtagtggctccatgcaagcgaccggaactgacggtatgccaccgggggcaccagctgaaccggcagaaattgctacggatgatttaccgttttagtagtagtaatcgccggagatttatgctacaattttaactcgtgagtatccggctatttttgtagccttattactccttgctccggcaaacgaccggggcctaaagtccacaaggaggtgaatcgtcatggctgaaaccaaatatgaagtcacttacatcattcgtccggatctggatgaagctgcaaagaccgaattggttgaacgttttgacaatattttgaaggaaaatggtgccagcatcattgattccaaggattggcaaaagcgtaagctcgcatatgagatcaacaagtacaacgaaggtctctatcatatcgtgaacttgtctgcagaagatgacaaagcgatcaatgaatttgatcgtcttgccaagatcaacaatgatattctgcgtcacatgatcgtgaagcgggaagactaattgtaactttttgaaaggggcgctacggcatgcttaacagtgttgcattgacaggtcgtttaaccagagatgttgacttgcgctatacgcaaagtgggacagctgtcggttcattcactttggccgttgatcgccagttccgcagtgcaaacggcgaacgggaaaccgacttcattaattgtgtgatctggcgtaagtcagcggagaatttcgctaacttcaccaagaagggatcattggttggtgttgaaggtcacattcaaacacgtacttacgataatgcgcaaggacagaaagtttatgtgactgaagttgtcgttgaaaactttgcgttactggagtcacgggcaaccacccaacagcggccatccgaacctgctaatcctgcaggtcagggaaatcagaactatggcgggggacagcagtttggcaacaaccagccgcaaaatccgcctagctttggctctcaaggcgccccaagtaatgcaccatcatcgaatccgggacaaaacccggcagcaggtcagaaccaaggtaacaacggtaatgctgctaatcctgatccatttgccaataacggcaaaccgatcgacatttccgatgatgatctgccattctaacgtttgacttttggtcatactatctagggtaagggatgcatattaacccccttactcgcttggaatctttgatagagaaggaggaattctcatggcacaacaacgccgtggtggccgtcgtcgtcgtaaagtcgacttcatcgccgcaaaccacatcgaatacatcgattataaagacacgaatttgttggatcggttcatctcagaacgaggcaagattttgccacgtcgggtaaccggcaccagcgctaagaaccaacgtaagctgacgatcgcaatcaagcgagcgcggattatgggtcttctgccatttgtttcagaagactaatcaagtatttaaaaaggatgttcccgctaaaaagcaggagcatcctttttttggtgagcgcgagccggcgcgggtaggtatcggagtgtaagcggccttgagcgtgatggccgggctttggccattgcgctcaaggtccttacacgcagatccctgcgccggggagcgcgttatgggcgtaaaccagaacataagcggccttgagcgtgatggccgggctttggccattgcgcccaaggtccttacacgcaggcttctgggctggcgaacgcgttatgagcgtaaaccagaacataagcggccttgagcgtgatggccgggctttggccattgcgcctaaggtccttacacgcagacttctgcgctggcgaacgcgttatggaaaaatttaaattattttaactgggctaacattgcctgattgaattccggcaagtcatctggtgtccggctggtgaccaagttgtggtccacaacaaccggttcatttttgacaatcgcacctgcgtagtacaagtctggacgaaccgtggtgtaagctgtcatcgtccgccccttggttaaaccagtctgaatgaagaactgcgggccgtggcagatggcgaaaaccggtttgtcatctaacaagaatgctttgacaaagttaacgaaccgatcgtcagcacggagctcatctggtgagaacccgcctggtagcagcaaaccatcaaagtcttcaggtttaacatcggtaatcgttgtgtcaatggttgccgttgcaccatgcttaccggtaatttgtttacctgcttgtgtttcaatcaaggtcacatcatgcccctgatctttcaaagccttaactggtgaagtcagttctgcatcttcaaagttatcggtaacgagtacagcaatttttgccatcgaaatagctcctttcaagatatattactaatttagtttaacggattgaaagaattcatgcaaaatatagaaatattaatgaatatcgaacgtctggcagaacgagatgcttgttatggcaaacatgcgttattttgggaaggcgttaagaacaaacgatagctaatatatcagtgttcggtagtgcttcaattgcatataaaatcacaagcttatcgttatataaaaatttgatttggttctacaataacggtgatcaggaggacaaaatggtatcatattaggattttgattatcagaggtgatcaaaatggggctcacattagcgacggttccactagcggttacgaatttatcgcggatgcagtttgcggtgaccgccatcacgcattttctgtttgtcacaacgactgtcggcatgttgctgacaaccatgatttttgaatttttatatgcctatggccgtggggatacggaaaagttcggtcggttgacgctgttctttagccgaatcttcttctttagtttcggtactggcgttgtgaccgggttgattatggaatttcagtttgggatgaattggtcggcattcacacggttgatgggcgatgtcgctggggtatcgttggcgattgaaagtatgatttcgttcttcattgagtcgaccatcattggcttatggcggtttacttggggtaaattgccaaagcgcgcccatgcttggttaggtgttggcatgttaggggcatcgctgttttcagtggtttggattattgcaattaatgccttcatgcagaatccgtatggctttcacttggaaaacggccgcgcgcggttgaatagtttgattacgttgctacagaatccgcagtaccagccggaatttttgcatgttttgtttgccattctgatcaccggcggctttgttacagcaggcgtttctgcttggcagattctgcataaacgggatacagcggcgtttaaaattgccgtgcagatcgggttgctcatcgcgttgccagctgcctttttacaaccggctcaaggcgatgatcaaggagccgccacggcagcgttgcaacccatgaagtttacggcgattgaagggcgctacaacacggaaggcagcgccacaactggggcaccatgggcaatggcagctttgatcaatgaaaaggatcggacggttaaggcagtttctattccgaatttaggcacttattttgggaagaatacttttaccggagctatgccggggatgaacgcggttgctaagatgtaccacgcgaagttcgataagacagttgctaagtcttacgatgggcagatgaattattatccgccagtcactttgctgttttggacgatgcatctcatggtttacgcgggctatttcttcacgatgtttgctctttttgccacgattatgttgcatcggcgcaagtctggcattgaagctcaccctaagacgttgcgcgctttggggtggacattatggctgccgtacctgacgtttacttctggctggattgtggctgaagtcggccgttatccgttcgtggtttatggtttgttgacgcaatacgatgcagtttcgccaagtctcacggttactgaagcggcaacgagtctagccatgtttttcgttgcggatgtgttcctggttagcaccatgatttatatttcgcatcgaacggtaacgcgcggactgccggagattgacggtaattatctggaagaacaccaaattccggatccatttgccaaggaggcgttcagtcatgcctagtctttcgaatttacaagtcatttttcttgggattattgccactgagctgatgttgttctttgtacttgatggcgctgacttcggggccggaatggcgaccttctttgtgggtgatgatttagccaagcgtcaacaaatcatgaaggtaaccggtccggtctggggtggtaacgaaacttgggcagttactgcctttgccgtgatgtttgcggcgtatccgggctggtattcggcattaacatccggctattacccgctcatcttcctcatgttgttctttttaatctttcgtggggtggcgtttgattatcgcaatcaatggcacagtcgccactacaatcagttttgggactgggcactgtttgttggcagtttgatgccgccgtttttactcgggatcgtgtttagctcgacagtcagcggcgtaccgattcgtaatggcttcgtctatgccgggatgggcgatattctgaccccgtttagcctattgggaggtattttagtcgtcttgttaagcttgaatgtcggtttggcccgcgtgattaaaaaagtcaaaaaagacgttgcggttcagttgacagtggccttgaagcgcacgacttgggcactttatctggcggttggcgtatttgcggtcttgctgccatttaacacgcgcttcttcaccaatcggccgggtatcgtctcactcctgttgctattactgattgtgtttcttggtgttgaaacttgggcgatcctccgccagcggcaacggcttgcgttttggttaagcgttggaacgatggccagctttatttacacgattttccttggcgtctttccaaccttaatcgttggccgcacaccggggacttcggtaacagccttaagcgccaccagcggcccagtttcgctactgtggacggcatggttatttggtttcaccatcatattaatggtcggactacaagcgacggcctatcatttgatcaacaaatattatcatgaaccggcatcaccaatggtttaagcgacacaacaccgcgttcatggcaaggaggcgcgagggatgaagaaaatctggatcaacgtattttggggtctgttggtggtcagtttttggttgtatcaagtcttttggccgctattctggaacccgatcagtaagttctatggcatggtcgttttatacagcattgcagttgttgcattaggattggcgattcgcgcaacggtgaaaggctatggacgacaaaaagtttgaatgagaattttattgacgtcagcaaaaaaggtctctaactaaatagcggcctttttgatagcgtcacacagcggtatgttaaccgagttgatagtccttaacctgacgatgcaagtctttaaattgttggcgataatgccagacgacaataaggataagcaaggtgaacagcagcaatgtaatattgcttcgctcaatgccgaatatgccaccggttagccactgagcggaggtggttggtactgacctgaagaaaaggtttgtttcggaaaagcctaataccgatgtgccaaagaggatgcctgcagagatgtgccaagttgcatgaaatagcactgcaaagccaaatatttccggaaaggagccggatttcagacatcaaaatactaccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgctacaattcaggcccttcaggctgctggtgacaccgcgaccgtgattgcacagaagcttcatcgcagtaaagcgacaatctcacgagaaatcacgcgtggatctgtaactcagctcgactcgaagcgtcactcgcatcaagtctatcttgcggaaactgcccaagccatgcacgaccgtaaacgcgatagaaccggtcactacgcctttcttaagaccggccgtgcgttcttcaaggctctcgccagggagcttactcgtaagccgcgcgtacacagcgttgatagcttcgtacacttctatcgcgaccagggcaaggcttgcccttcaacgacaactgtgtatcgctacatcgacgccgggctgcttgcgctagacaacatgacacttcccaagaagctccgacgccgcatcaaaggctataagaacgcccacaagcgcaagaataagaagatatacggcgactcaatcgagttgcgtcctgcggccgtgaatgaccgcacaggcgtgggacattgggaaggcgacttggtcaaaggtattcgcttagctgatgagccagcattaatgacgctcacagaacggtacagccggactgagatcatcgtcaagattcctgactatcatgcggacacctgccttaaagccttgcaggacacgatcgacgactacggggccaaggaatttgagagtatcacttttgacaatggttccgagtttgccaagttatcagagattgttggaacccagatttacttcgcacatccgtactcgccttgggagcgtggcacaaacgagaacgccaatggactgcttagggaattcttcccgaaagggaagtccctcagagcagttaccctggttgaaattcaagcagtccaatccgcactgaaccatcgtcccagacgtattctgaactatcttcgcccatgcgattactaccgatgcatggcgtaacagcctagaccactatcaagaattcgttatcatcgttgcacttgacttgaaaattgaggacatcaaaatactaaacaggaaaagattcaaaccggcgtgccaatcaggctcaaagtttacggaatcaaataagacaacaaaagaacctttatcctttacggaacgaatagataaaggttcttctttcaagaaagatgaaagggtgtagtaccttggaaaatttgatgaggatttcccattatttgtactcgtttaccccctgtagcaacttgcttagggaaatagttcgtcccgtacaataaatctaccccattctgcttgtttttggtgaaagtttatttaaacgtcgcgaattcggcaataatcgttaaagtttcgcctgaaatgacgtttaatggccatttcacgacgtttatctgtcagctattgacaaatgctgataaccattcgtatcatttggcaggcgtatttgatgccgagcgtgggcgctgatagatgcctgcagttgttgcggtgaagcatctgccggtaccctccaaatacgaaccaagcccatcaatcgattggaagattgacgttcgctagatagccgaatccatacatgatgctaactgaaagcagagcagaacaagtgaggcaagtaccaaactgagacgttgccaaacatgagaggttgggaaaagctgcagaatgaggatcagtatgatgactgtcattcttgtttcgaagagtgtaaatataattattatgataattttgaatatttttcaggaactaatcgtttgtgatagaggttgaatgtgtataagaagattcggcaattataatagactgtcagttgcaatgatagctcttgtttgctatcaattgccaatgtaaaaatacagcgataatccctgtaacgacaagaatagaaaaatcttcagaggccatatcttgataccgactctttttttaactattttgaatggtagatttatctaatgactgaatagttttttgaaattaatgaaatagacaaaggagcgctagtttgtgaaatatcaagaaagttcccttatcagaagaagcttttatatgctcgtattatatttgttgagtccatcacccctactttttttgctgatcatgccttacacaaataatgtagtatcatcgctttcgctggcatttgcgtgtgttacgtcgagtgtcgtagtaatatatatagcgtataaattgtttcataaatacaccaatcaaaaaatcattcagcgggttaaactgagagatattttttacgtgattggtggctatctgaccattttaattagcaatgaaatcctgacaaccttgaattatacgatttatcagcgggtacaaacgtcaaataatcaggtcattgaatcatctctgttaaatcacaatcaacttatggttattcttcttgctattaacgtgattgtattgggtccaatcacggaagaattggttttccgaggaatcttaatgcatttattctttaagcaaaatcagttattttttaaagtgctattgagtgctctcatatttgcttctgcccatggtggcgatacgattattggattcttgatgtacgttgttaatggagcagtgtttgcagttgtctactttaagactgggaaaatacaagacacgatcgcccttcattttgttaacaatattgttgcggtatcgacaatattatttctgtaattggtaactagctatttttaaatatatgaggttcaaatggtactcaagccaatacataccaatactttaaaagcgattcatatgtctagggatcttaaatttaaggttcttaaaaattcttgaaattcaacattttattgacattcaaattttataagagtaaattacacaatgtaaaatttagctatacctaaaattttgggggacaatttttatgcaacagttggcaactaaccggtcggaatagaaacttacggaaaaggatctcatgatggtatctggggtttaatgcagggaattaccggaatcgtccctaaaggctctaagttctgaggatggccttgtagtcaccttgttgatgacgaggccattttcatatgtaggtgaataaatgaaaaaagaaccattagcatccaagatctttgttgtcggggtcgtcagcttcggctgggcattcatagcacagatagttccaactctcatgggtatgtttggtactgataccaaccttttgattaaagaccctaaatagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaacccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaataagggttgcacttattatacgccgaactattggtaaatcctattattaaagtacttttatagtttttcaccatccactaaatatcagctattatttctatatacagaactgatcggcattttaagcatgtggttttactaccatgatgacgtcattttagttccattccgaggaagaaaaccgatcagaagttatctgaaaggctgggtttttggccttttcctgttcttgctagtctggggattgattgtcactttgggtggatacgatatacatatcgttttcgatgtctctaacctcatttggcttcctttatttctctttggctttagcatacagtcaatgtttgaagaacttctgtgccgaggctatgtaatgggctactggataaaagaaaaacgtcctgtattagcagttattataaactcaattcttttttcttctttacatattgctaatccacacttcgattggtattctgcaatgggcctatttctatttggagttgtgatgtctgaattgcgaattattaatcataacattctaatgtgcggcgctgtacatgctgcatggaatttttttgaaggaactatttttgggactacagtttccgggttgccaaacatagggcttgttttcaaatcaatgaataagacgacatctcaaatgttaacagggggttctttcggtatagaacgtagcggcgtttcaattcttatttatgctgttttggctatcacattggcaataattattaaaaagagaaaaacgccagaatctctttcgtcgcctacttatttacaagcagatgatgtctaaatatgacaacatctaaagagtgaaagttaaatatccgtagaagtcccgagaaatcgggacttttcggcattaaaaaagacgcaaaggtttctgcgtcgtataattaattcgaccaaaaccaacatataagggaggctttaagtacagtcgactacagttcctcccgtacaataaatctgccccattctgcttgcttttgatgaaagtttatttaaacgtcacgaattcggcaataatcgttaaagtttcgcctgaaatgacgtttaatggccatttcacaacgtttatctgaaatgtttgctgattaccattcgatcatttggcaggcttatttggtgctgaacgtgggcggtgatagatgcctgcaattgttgcgatgaaacatacgccggtacccatcaaaacgaaccaagtccaccaagcaatggggatgttcatatcggctagatacccaaaaccatacatcaagacaagctggcaactgcccaaaatgagggcgcagcaagctaagctaagacgctgccaaattgttgtcatcgaccaaagccaggcgctgattgtcactaaaatctgtacagcaaagattaaggccatgagtagttgcaaaatcgttcttaaataagccgtgatgaccagtcctttcaagatcaataagcattgcagtagaaaggcgcgaatccattcgtaccagaatgctaattgtaaaacaaatacgatagcagtagaaggagttcgccctcatctatagtacgaccaatcatctcagtaagaattgtcaataccagacttcttactggatcgataaattctttgaaaagcgagatggcctacatacacgtaaataagggactgaacacagagcagcaagaaagtgtttattgaaacgctgtgctggttgattaattgctttgagagatcgatcccaagggtaatcggcaacattcttccagaaatctgaacaaactcaggtaattgcgttaatgggaaaattgaacctgttaaaaataataggagatacgaaataaccgactgaaaagaggcggtttttgtatacttcagtgttaaagcggcgagcagtaaggagaagccaaaaattccaatgcaagtaatgaaaaagatcggtagtagcccgatatgaaatcctatgttcaagtgaaatatgaaggcaataaatgcaaggacgatgaaaactttaatgaagttaatgatgatccaaacggttgtttttacagtgagaactaactcaagtccagctggtcttagcaggagttggtctaatgtgcccatttgtttttctagagaaatactttcagaggcttcaccgataatcgaactaattagtggctggtgaaagcagcataactgcaagctttattggcatcaaagaatagtaaagattataattagtgcaaagtaaacatgggctaacgcctgttttccttgcactttttatttttcctggaggaaaccatcatggcttatcgacatcgtgctacccaattgtcatttcaatcctttaacaacggccttggtgtgccactctcttccgacaatgagtgggttcaattagccgacatgctcccgtggcaacagctcgatgaagcctatcaacttctttttactgagatgggtgggcgcgctgctaaaccctttcgtctgctttacggtgccagtttgatcaagcaagcagaacatctaaccgaccgttcggtcgttaccgctattcgtgataccccggcttaccagtactttatcgggctagacacctacacaaccgacctgccgttcaaccactcaaccttggtttattttagacgacgcatgggtcaaataacggaactagtgcgaaatatcatcagtgataccttgcgcgaacaaattcaaagcttattgccagatgatgagctccgtgtcttgatcacagacgctactgcggtgccaattgaaattcgttttccacaagatacttcgctgctaaatcaagctcggctcaatctagaagaaatgttattagacatggctcatcagttgcaaatcaagcctccacgaacctacaaacgtgaagcaaaagctaagtggaccgcttttgctagaaaaccgcggcgttgggctaaggaaacacgcaagcagatcaaagtacagctccagtatgtccgacgtgatctacgttatatcgatgtgctgttggcccacggtgcctctcttaacgaaaggcaaaccaaacgattggctgtgattcgtgaactttttgaccagcaaatgttcatgtatgaaaatcggacccatcgggtcccaggacggattgttagcttggcacaaccgtggattcgcccgattaaccgtggtaaagccaaacaacgaaccgaatttggtcccaaaattgatgcttcaattgccgatggcatgatcgatatcgaacgatttgattttaaggcgttcaatgaaagccaagatttagcaacaaccatcgatcattatttcgacgtgcatggttattatcccgatgaaatcttagctgacacactttatcgtacccgcgagaatcgtcagctctgtcaacgactaggcattaggttgtcgggaccacgtttaggacgtaagcctaaaaagatggatgctaagcagcggcaaattgatcgtgacgcagagaagcggcgcgggaaaattgaacgcggttttgccttcatgaaaggccctttgggcctttcattggtgcggactaaaacggtagccagcatcgcagtgacgattgatattgcgatcaatctagccaatctaaagatgctattaaggctttttaatggaccaattttgatttttgtaaaatataagcaggaatccatcttaattcactatcaaattcacgtttcaggtagccggaatgttgcctaattcaccagccactaattagataccagtaggcatacccgatataaaaagcagaatttccagcatcaatattaagaaaagtaaagactacaaaaatgagtacagtgacgaccatactggtaatttgatcagggaaataagttctaacttcggccagatatcgagaaaattcggctttaaataaatgtatgatcaagtcttccactccctttctcgatcaaaagactaaacgtaaaagttcgtcaagcgacggataacgattttgcaccgcatgaacggtaatcccatgctcaagaagctttttaaggaattcttgttgatctttcaatgttttgaaagttgtcgtcacacgctttccgtcgtcgcttgagttgacggttattgcattgttggctttgaaagaaaaatgggatgaaactacaacgaaaccaaaagaagaaaaggttttttggaattcttcataggggccgaagaatcgtactttctggttatcgataagaaggacatcatcgacaagtttctcaagaacatcagcttggtgtgaggtaaggataattgtcttgtgcaactgctgattgatttcctttatctgcctgattagcgtgcggctagcaacaaaatcaagtccaagggtcggttcgtccaagaacagtaagctggcattgctgactaaacaggaaatgagcgctagtttttgtttcattccccgcgagtactgaccaacgcgctggtcaatggcagatgaaagatcaaactttttgaaaagtgaattaatctcggaggttttgctggctggagaaataccgctgagattcaaaaagtagtttatattttggcgtccagttaaatagtcgtaaagattatcaacggattcaagaaccgctgccatgttacgataaagcgctctgtttccgtatgggatatgcttattttgaaaagtataatctacagtgccgcttgttttatcaatcaggtttaacaatatttttaatagtgtggtttttccagcaccatttttaccgagtattccggtgattcgccctgcttgaatcgaaaaactgacatctaagagaacggttttgtcttggaattttttgtttaaatgattcacattaatcatgttcatttgtttaatcctttatcatggcgagaatcagtgggacagcccttcttttaaactcatttttaggataatgaaatgttccagactttcgtttatggggacaacccccaagcaaactggaaggaaattaggttaaacactaatggaaaagggatagggtgttgtttgagttcgttgagaagttcagatatttgggatcttctaaatacttttctgctcatcagtaaaagtattttatcaaatatataaaacgctttcaacgatattagcggcggactgtaatttttgctgatttacaacaataatgaaaatcagaattttgataacaacaataatagcgataatgtgaaatcatgtaccgtgtttttaaacctgctgaaaaatccaataagggcgggcttcgtatccaacaagaaatgctggtaacatacctgcgtgcgatgtatttcagcatctttctaaaatattaattgacaatgttgttcaacaaatgctaaggtgaaaatcgcttcataaagcgtaatgattacgatttaaggggcgagattgcttttatatcaaccaagcgggtactaactggcgctgtatatctgtagaagcaatgagtccttgttggccgataaagaaatacaccatactgcgttgatcagttcgctagctttgtttgaaaacactggttaggaaccaaggctactcagactgaggcggcttatccggattggttgacgctaatgagggggttattcatgtttgcacttgtttgtttcttgatcatgttgccgatgatctttagtgtgccactgctgtatgtcgggatgttgccacgggttcgccagcaatcagcacttttaaccatgagtattgcgttaatgattgcgattgtctgttggttggtttttggtaaccgcctggcatttggttttgacttattacatgcagcaactttttcatcattatctgctggcttggtacaaatggatttttacttatatgcggttgcgatgttgatgggtacgatcgctggtaacaggaacagccgctacatgtttggctttgttccggtgtggaccgtgttggtgtactgcccgcttgcacgctggctatgggctgatcatgggtggttgcgacagttaggcgctttggacttttccggcggcattgtcgtgcatttgacggccgggttgacgagtttggtgctggcaaaagcgttacttccaggtgatcagccgagtatgccaaatgattttcgaactgattacgcggcaacgatcatgattctggttggctggttagggtttaacttagccccggcaggcagtttgaatgagcttgccggacaggtgctgattaatacattcgtggccgtgttgatggcgataatcggttggtgttggctgacttatcggcaaaatggtgtggtgcagttaggcgatttgttgaatggcgtgctgtgtggtttggtaaccagcaccgctttagtcggatacgtcgggacattgagcatggccattgttgctgccgttgctggcgtgatttgtcggcagatggtttcaaaaatgcagcattcaaaacatttctatgatgcggtagattcttttgcgatgaatgctatcggtggcattacaggggttgttggcttgatgattgtccaattctttaatgggactcatacaatagcgaccgcggggaagttcgcagtggttgaacttttagctgtagcggtcgcggctgggttgacagttattggcacaatggttgcgcagttagttgctagggcgtgtgaagctggcgtaacacgggtgatgaatcttgacagtgaacggttgaattgacaaagggagcgatttggatgaatcaaatgatgattattggtggtggagcagcgggcgttggtatcggtatcatgttaaaacaacttggctgcagtcaatttcagattcttgagcaggaagaaataggcgcgagtttccggcattggccaaaagaaacgcgattcattacgccatcctttaccagtaacggattcggcatgccggatttgaatgccgtcagtatggagacctcacctgcgtatacgcttggtgcagagcatctgagtggttcacaatttgccgattatcttaaattattggcggatacttacgcattaccgatcgctgaacatacgcgcgttggtgcaatttcaccgactactgaaggttatcaactcgaaacgaatcacggcgtcgtgaccaccaagtacttgatcatggcagtcggtcagtatgctttccctaaattaaccgatcatccggaaaacgtcattcactatcagcaagtgacctcgtggcaggatttgacggggaaaacccagattgtggttggcggaaacgaaagtggggtcgatgcggccatcaatttggctacgctaggccataaggtgcttttgttgactaaggaaacgggtctgaacgcggcatcgcctgacccaagtattcggttggcaccgtacacgcgtcggcgattcttggatttgccagcggaagttgctgaaagaatcacgttacaagagaagattgcgttgaagactgtcacgcgcacccaggattcccagtatcaattgtggtttacagacggacgtacgattacgacgccgtataagcccgttctatgcacaggttttgatgccggcccgttaaagctatggccacaattatttgaaaataatgatggcgaaattgctttgaatgacgttgatgaatcaactcaggcgaaaaatgtatttgttgccgggccggatgtacgccacgaggatgcgattttctgttacatttacaaattccgtcagcgtttcggagtgatcgttaatgagatcgctaaacgggaacagtgggacatcggggactttgtcaaaatcagtcgcgccaatagtttctaccttgatgattgtgcaacttgtgatgttgcttgtgactgctgagggagcgggcatttagaggaggaagctttcatcttaagtcagtaaaatggcaacgcccacttccattaagttacttttgcgtcaatacacataaaaaataaccctctgaacatgtcttcaaatgacagttgttcagagggttatttagttcaacggtatttttaggttgggattcattggtgaggtcccaagacgtgacattaagggtgggtaaaaattaccggtggatgtaaacgtagctgctggcaccagagatggtctgggtgttaggaccggttggtgagctgaagcccatgccgccttgagtgatcgtaacgctgtcgccagaaacagattgaacataagcaacgtgaccataagagccatcagctgtccattggccgccaacagattgaccagcagcgaagacgatgatggaacctgctgccggggtgtggttaaccgtgaagccggctgctgcagcggaagcgccccattcagcaccgttgccccagccattgcctgcccatgaagcaacagacttaacgtaccatgtgcactgaccccaaggataagtgttacctgaaccgctgtaatcagcatggctgccgctacctgaagcagtgttgctgctgatcacagtagatgaggcaccgctgttggaagaagtgttggttgatgaggtaccagtcgaaagaacactgctgttggcactcttatttgaagttgagctggtagaacttgaagcagttgatgcagctgctgtcttcaaggcagcctgggttgctttggctgcttctgattgttcttgagcaaattgactttggagtgcaaccaattcgtctttgtgatcagcaatttctttgttcaaagcatcttgcttatcgcttgcggtcttttgaagggtctctagctgtgacttttgcgtttcaagagatgctttagtcgaaaccaaggtctgacgtgccgtttcctgttcactcttcaaagcggctaacttatctttggcgacggttaccgcatccaaagcgtctttgctggcttgacttaacttgccgactgtcatggtacgggcaatcaagtcagatagactttgtgagttcaacacgaaatcaatatagacattgccgctaactgaactgccggctttcttttgaagggaaatcaattgatccttcaagttgttcttccgggctgcgacgttcttttgagcagcggtgatttcgccactcaacgatgcgatcttggcatccgttgcactgatcttggcagtggcgtcactgatttcgccattcttagcatcaatctgtttgttgaggttgatcacttcagtgttagctgcttcgatttgctttaataaatcgttggtttcgctcttgttagatgcgatgctggcacttgtgtcagcgaaaaccggtgttaaggcgctaacagaacccgctaaggtaactgctgcaaccaatgtcatcattgctttattgaatttcatgtttgacctcactcttaattaattaactaaaggctactttactgtgtcaatgttacgtcaccattacaggattgttatgagttgttctcaatcttcatctgggcgtcaaatttgcggcattttgagcatttagtggcgatttttcgtgaattttacatgaaaaaagcagccgcgatccgcgactgcatgacaaaattgtaagttactcgtttgatttcagtgcctcgaccatatccacacgttgaagtcgccggtgcgtaagccaggtgacaataccggtaaaggccatcatcaaaagcgtggctgtgagataaccgatcatactaatcgtcaacgggaagacaacggcctcggtttcggcttggaatagaatatagacggttaaaagattacccagtccatagcctaacaggatgccgacaatggtaaggacgatactttcgcggctgatatacatcgtcacctcacgatcaaagaacccaagcactttgatggtggagagttcgcgaatacgctcggaaacgttgatgttgtttaggttatagaggacgacgaaggataaaaccgcactaagcaaaataaagatcaggacaatcgggtctaacatgccactcatgttgtgcaaggtctttttcgcggtggtggtgaagctgatgcccacaattgcatgatgattcagcagacgtttagctaagcgatcgtcctgctgctgactttgcgggcgcaggcgaacgagcagcgagtttggtgccgactgtttgccgactagttgttgatacgccgtggcagagagatagccaaaatgaccgacatagtttttggcgatccctttgacggtaaaacgatgggcttgaccagccgtcgtcatcacctttaaccgatcaccggtgctaagcttcaatgcttttgccggtttactggtaatgataatgccggtacttggcagggttaaggcttggttggtagacgttgaacgcagactgacgtaaggttcaagctgtttgccgcttgtcggagcaaaaagattaacatcgctaatttggtgaccgttgctgcttaatttggcggtggtactgctaacactggcggcactacgataagcacgacttttttgcagaatcgatttggcagcggttggttgcttaccatctgccagtcggacgatggcttggtaatgaatcacgtcgccatattgtaaagtgccggtcgcggtaatggaatcctttatgccaaatccggtaagaatcaaggcggttccgccggcgatcccgagaatggtcatgacgaggcgtgacttatagcggaaaagattgcggtaactgactttttgattgaatgaaaggcgtgaccataaaggggtgatgcgttcaagcaggatccgtttggcggacttgggcgcacgcggacgcatcaaagcggcgggtttttccgtcagttcattgcgcaccacgatgatcgcagcgccaagagttgcgattaaggctaatagcagcgacaaaaagatcagtggccattgcagcgaaatcacttgcttaagcgggatgtagttcttatacaggcttaagacgatgcgcgggatgctgaagttgccggcaaagacgccgatgataccaccgagtaaaccggctaaggcagcataggccagatagttacgggcaatggcccatttgccatagcctaatgctttaaaagttccgatttgagcgcgggcttcttcgaccatgcgacttacggtggtaaacgtgattaatgccgcaacgaggaagaagaacacgggaaacacattggcgatggcagcgatacgatcggctgaaccgccataatccccgaagcccggtaaatcatcgcgggtttgccatgtgagactagtggccagttggtggcgggccgttgcggttgcttgctttttgaaccctgcttggtaagttttgactgtttccgccgctgttgccgctgctgcggtggcaggcatcccagctgcaactgcttgattagtggtcttggttattgccgcttgggtcattttagcttggatggtcttggctaaatctgcttgcgcctgcgctttaacgcgttgcttgacctgtttcattttcgcagttacggcgtcttgataggctgtgctgaaagtgtcgcgggtttgcaagtttggaaagcggatgttgagctgcgaggcaacaggcaggttcatttgctgatcggggatatacgcaaaataacggaccgtgccatccccgatatttgccgacccgcggctagtgtcttcgatataggccggtgagtcagcaaaaccagtgatggtatacgttcggtccttaagcccgctgctacgtgcaaacgtgtaatgctggccgagtcgatagccgctctttttagcaacggtgtctagcacgatttcattacggtgcgtggggaggcggccactggtgaggtggaggcgattgattgtggccgttttttgatagccgtataaagcgacaacatcacttgagcggccaccgattgcatatttgaatttaaccgcttcggcttgggttcccttgactgactgtgccgctttgacttgggcagagctgacgccagtagttgccagcagttgggcatcggcgaggtgatcggctttgacggtcgtattcagcgagtctttaagggcgggacccgtggctttaacgccgacaaataaaagcacgccaagcataataatgatgacaatcgcaatgaagcggccgagtgaatcgcgaatgttacgccaaagatttttagttaatggtttcaaactgatcacctaccactcgatgtccgctaccggtgtcggtgccggctcgtcgtgaatgctgcgaacccgggcatcattgatctcaacaacccgatccgccattttggcaatcgcggcattatgggtgatgatcaagacggttttatggtctttgcggctggcatcttgcaacagctgcaagacctgttttccggttttgtaatccaatgcgccagtcggttcatcacataaaagcagtttcggattctttgccaaggctcgggcaatggccacccgttgctgctcgccaccggaaagctgcgaaggaaaattatccagccgggcgcctaagccgacttgtttaagaaccgtggtgggatccaatgcatcagcgacaattgagccagccagttcaacattttccttagtcgtcaggttaggaatcagattataaaactggaaaacaaaaccgacattgtgccgtcgaaaagctgtcaattggcgatccgaaaaagttgcgatatccgtcccgtcaatccagacttcaccttctgttggagaatccatcccgcctagaatattcagcaatgtcgatttaccggcaccgctgggaccaagaatgaccgtgagcttaccttgatcagccgaaaaattaatatcgtggttggcggtgatgacggtttcgcccatttggtaacgttttgattcatgttttacttcgatatatgccattgtgacctcctgaagggtgttgagatagttcgcgcttgagtcaagcctgcgctcaacacgttgttcatttaataacattatgttagattaaaaccagtcgttcaagcacagaatccggatatctgttgttaaatgaacacgttgtacagatcatgttggtttggaggttatgatgacaggtataagcaataatcggcgagtacaatatactgtgagccagtttaaagcggcgttgttgcaaattctggcgacaaaatcgctggatgaggtgacggtcactgagatttgtcggcaagcggatctgaatcgaggtaccttttatttgcactttgcgtcaccgctggcattatttgaacaaattgaaaccgatttattaaatgaaattcaaccgtatctcagtgttaaaatagatgacatgaccaagatgctagttccgattctcaaggtcatcacacagcatccgcaagcggccacgattattctgaccaacccggatagtacggtgttggagaaaattgtccgcccgattcagacgcagacgcaagcacgctatcaggcatggtaccgtgaagccgatccaaaacagctcgcttattactacgcatttttcgtgcaaggggcggagggcgtgttaacgatgtggttgaaacaagggatgaaagaatcaccggaacaaattgcgaaggtgatcgaaaatgtggtgacaaaaggagcgccgcattgagcgagagccgtcaagcgctagttaattcattaattaggagaaagaaatgcaaaatgtaaaattaatcgccagtgacatggaccagacattgttgaccagtgaagggacactaccaccgcactttgatcgttatcttcggcgcctcaatcaagccgggatcgaattcgtggctgccagtggtcggccgctatacaccttgcaggaaacttttccgcattttactaagcagatttcattggtttgcgataatggtggattggtcgcctcgcatggtcagatcatcggcaagagtttaattccagccgcagcgtatcgcgagattgtggcgtttatctgtgacaagaccgatggcgttcccgtcttatgtgccttggatgctgcctatattaatgcggcagatggccagtatgccccggcgctattgccgttttatcatcaactaaaaaaagtgcctgatctgatggcggcttccttggaagtggacaaagtgacgatttacttccctaatgccgatagtcgtgccaatgcggaacggtatttccggccggcttttggccaaaactacacggttcaagtgagcggcgaaacatggttggatattcagaatctgggggtgaataagggtcgcggcatgcgcattttaagccgccattttgatattccaaccgcacaaatgatggcatttggcgattatgataatgacattccgatgttagagacggtcggttacagttacatcatggcgaatgcgactcaagggatggcgcagcacgcgaagtatcggacgcgcagtaacgatgagttcggggtcttgcatgtgatggatcaagtgttgcaggcgcaggaaggctagtaacaaatatggcggagattttgattcgtgtggtgatcgggttttatggttttttgatgctgctcacaatctggcaagcgggaaaaacgaaccagaacgcctcgtacttaaatcagctattcgcactggccgctacgctagtcctgacagcggctgttattcctgacaaattcagtgctttggtcatacttttgatcgggttattaggtctatcagcggtatcgtggtttaatggcatccgattgtatggcaagccgcatatgaagcatcatctgattaggttagtcgttcacttaatcttatttggattagcaatgtggttgctgtgagcgtgatggctttttgtgcaaccaaggtcaatgcaggtataaaaatacagggagtatgatgtgttctcacaatacttccctgcaaaatcgtgattacaagctacacgccgccagtactcgctaaagttcatgcggcgtttttgcttgcccggatgaacgataggactagggagactacgaaaaatcaaagataagcctgcgcaaataattttgctgccagcaggaaggccagtgctgcaataatgacgcgtaataattgaaccggtaagcggcgggcgatgatcgggccgatgtagccgccgatgaagagtccgatgccaagcggaatgaccattaaccactcgattttagtggtgaaagcataaatgacggtggcaatggcgttagctgcaaatccggtcagattcttcattgagttggagacaataaacggctggtcaactgtcagggttaaagttgccagcatgacgacaccggcagcagcgccgaaataccctgcgtaagcaccggttacgaaaataacaatggtctgtgcagcttcttggcgaaaggttaaggttttcaccggctcgcctggacgatgctcctgggtcggcagtttaccactgaataagagtaaaagtcccgcagcgatgatgaaaaacggcacaatcttttcaaatgtcgaagccggtgcaatcaatagaagagcactaccgaaaatactaccgagtgacacaatcagaatcagacgccaaagaaatttaccgcggccgcgcagttccggcagtgaggagacggctgaaccaaccccagtgaagacgagtgccgctgtattggtgacgttagcaatgactggtggcacgccgattgcgagcagggctggatacgagaccagtgaagctaaccctgctaacgtagcagtgaggccggcaccgatcccggcaaccagtaaaaaggcaaagatcgaaaaagtcatagttgctgctccttcaggaatttgtatgaatgtcagccaacatagtgcgcaacaccatgtatcaggattgcataggtacttataagctggcaaacattgctagtctcatcatacgctaaagcacgactatttgggggtatgataaaaggtaaagaagggacagatgcacatgtttgaaaatagcaaaagccggcttgatgccatttcggatggcgtattcgcggttgtgctgacattgatggtattagatattaaagtgcccaaaacgctgaccaaagtggacctttacgcaaccgggttttctgtcgtcatttactttatcagttttgcggtggtcggtcagtactggatctttcaccaagaacttttgcacactgttcagcagccaagcaccaattttttggtattgaattttttctatcttgtgttcatctgtttagtgccgtttgcaaccagttttatcagtgaccatccaggtagccgtattagtgcgacattatttgcagttattatctttatggttgatctgtttcaatttattttgttccgattagtcattggcgagcgaccgaaaaaagaaaatttaaatgctcatgattgggaggaatatcgcgctgcgtcactaatggtacttgttgccgttatttatattcttgtaggtttactgttgcccaagtggattcttgttgtgattgcgctcggtttaggcgcccgaacgttgaataataccattggacatcgacttcaacatcaaggcaagactcaataaaacgacgcctttataaccatatatttttaccaaactaaagatcgccccaaaccatctgatgagggttttgctaggatcatcaaatggccgattttttacgttgcgtaagtctgtgatacgatgaggcagaaacgaggtaactacgaatgcatggcacaaaaggattactgacattaaaattggttcaggcacaaatgactaacgtaaatgcagtccaacattgacacctataaaggagcgatttcatgacgattcaagataagatgcatcaaggggcgttgtatcaaccgatgaatgcagatctgcaaaaagaacagctggcggcaattgatcagctggcgatttacaaccagattccggcgagccatcaagcagaacgatttgcccaactcaaaaaaatgttcgctgaaattggcgctaaaagttatattgaggcaccgtttcattcaaactttggtggggcgcatgttcattttggcagtggtatctatgctaattttaatctgaccttggtggatgacacccatatttacgtgggcgatcgcaccatgttcgggccaaacgtgacattggtaactgcgactcatccgattgatccaagtctgcgcgaacaaggctatcaatataataagccgattcatgtgggccgcaattgttggtttggcgccaatgtcacggtgatgcccggggttaccattggcgataatactgtcatcggcgctggcagcttggtcactaaggatattccggccaatgttgttgcattcggttcaccttgtcatgtggttcgaaacattacggaagaagaccgaaaaacttacgatcacggtaagccaattgacctgtagcgaggcttagtcagcccaggttacttccgcaaagctcaaaataaaagttttgacggcataacgattcagccgagcagtcgtctgcttaagttccgcctgcgaaacaggggagggcttgacgtaataaaccgttccttcatcgtcatgactatatgcaggggcataagcattttcagaagaacgctgaatgcgggcgcaaaacgcactctgaaaataaccgttcattagcagctttgtcctgacagccattgtcgggattagatggccaatgacgaaaagcccgatgatggtataaataattgtcgcaagtttctgattaagtgtcatcttttttaatttggtcataggttgtcctcgctagcatgattttagcggcttgatcgaataggaaaaccggttgtgaaagcaacaaacgatgatataggtatgtagtggtcgactaataagtgtcaagagaggcacatgtttaaaatagcgccaactcgaactggcatcaaggcgaagttttttggtctaaaaattttaacgcaaaatgagcatagattgggaaaaatcactcgtccagtcccagcactcggccctaccagtgctatgataaaagcaactgaaaggaagcgtgtctatgaatcagtttgtgaaccatttgagttgtacagcattgcttgttggtaagaaggcgtcggttgatggctcgacgatgattgcccgcaatgaggatgcggcaggcgggattaatccgaagcggtttatcgttgtgaagccggatgaacagccgcagcggtatgtgtcaacgtttaacggttttcagttggacttgccgcagaccccgctgcagtatacctgtaccccagttgccgacacgagcgatggtacttggggtgaggccgggattaacagcgaaaatgttgccatgagcgctacggaaaccgagttcacaaacaccacgatgctggggctggatccacttgagccagatggtatcggtgaagaggctatgctgacggtggtattaccgtatatccataatgcccgagaaggggtgcagcggcttggcgaattagtgacgaagtatggcacctgtgaaagtaacggcattgccttttccgatgctgatgaagtctggtattttgaaacggttggcggccatcactgggtggctgagcggattcctgatgatcgttatgtattggcgccgaatcaaacggggattcaggagattgattttgacgcaccggatgatttccagtacagtgccgacttgaaggcttttgctgaaaagtatcatttgaataaagcgaagaaaggctttaatttccgcgatattttcggtgaagatacgcaggcggatcatttttataataccccccgtgtctggtatgcccagaagatgctgaatcctgaagttgaccaggatccggaaagtcggaccatgccatttagtcgggttccgagtcatttgctatcggttgaagatgtggcgatggttttaagcagccattatcaagcaaccgagtttgatccgtatgggcagacagggacggccgaaacgcggcatcgttatcggccaatcgggatgaatcgtaaccaggaaatgcatattttgcagattcggccgaacatgcctaaagcccatgcggcgattcattggctggcagaaggcgtcaacattttcaatagtccggtgccgttttttgccaactgcaccacgacgcccgagaatttccagtacaccccgactgataaaagttcgactgacagcttctattggctgaataagttgattgctatggtggcggatccgctgtttgccgaacataactgggatgccgaagtggcggtttcggaaagtcgcaagttcggatttgcggccggtcgcgcggcagtggccaaaggagacgcagggtttgcagacgtcaagcctgaagatctgccagcgtggcatgacgaattgaatgccgaaactgcagccacgatcaccaacgacctccaatatttgctgcatcaactggtttgcatccgcgcagaaaagatgacgccgacttttgaaaaaggcggcgaactatagcgctaatctgacacactttgaaaaaattgaatgcccggtcacactgacggattttcatcagtgcggccgggcgtttataatggtcaagaaatctatcaagagaatggaaagaaggtcttctcattaagaatacaaaaacagaacgctggatcgggttgattgtcggcttgatattaaacgcagcgggtaatggactttgtatcgttggggcgatgggaagtggtttgtggaccgccgcggcgattaatctcaatgactggcagggatggaatatcggtgcggttttgtttacattcggcgtgctcaatgccatctccaacttaattttgattcgacagtgggactggccacgattcatcggtgaggttatttatacgctgttcttcagttactttgtcaatgtttttacgtggctatttacttggctgggtctgggaaattggcctgtcatcgcccgaatctttgtttcctgctttggcgttttctgcttttgtgttgcgatttcgctgtatcaacgcgcgaatatcatcatgcatcccaatgacgacacaaccaatattttgcgcttcctgtactttaagggtaatgccacagcgtcacagttaaccgatttcattccaccgattattgtcaccgcgattgcttgggcggcgactggcaaactgttagggattaatattgccacattattctcgtttcttggcaatggtgtcatgattgcgtgggctgacgagcatatttggccgcaactgcaacataactttaaggttaaagctactcgatagaaatgacgagatgtggcgacgagggttaacttaatccaaatagcttttatggattagtcaactctaaagatttgtatcagaagatttgattttaagcaaaaatggttctaaattggcatagaattttgagtacagagggagttacacagtttttggcacttattgttgctgatttacaatcacgtgattaagcacggcaacatcacaacagtttttctctgagtttgtttttgttacaactctaattttacgttcacaccaagaagtttcgggatttaaagtaagattatatagtttgcttaatttaatgtaactgatcttgctttgtttaaacacgggagatctccacaacgattggtgtaattggaggctggatgaggtctactgcattatacgctgagtgacacagcttgcaatgatttagggagaaaatatggattacatttatatcgtgccacacgtacttgtgatgttagttttttctatcacgttaagaattaagaatgaaatgtttaaaaaagagcgaatagaacgaatagcgacatttaaacggattgactctgacgggggtgtcggcatggagaaagacggtgatgagagtttgaacacgctcgttggtcgaaatttgtatattgaaagaatgatgaattctcaaatgattgggagctatttggccgtcattttcttttctgcaggggttatctatgggaacacatctacagggcttcttcttttaccaagtatcggggtcttcctcctctttgctaatgtgatttttctgggtgaagaacaagttttccgcgtcatcaagcagagaaaattggaaagactctcggaaaggtacccaagcttaatgcgtgttcgaaaggttgggtcaaaatggtattatcgctaccttttactgcttgtcgtagttgggggactcaacttcgctatattttatgctgctgccgttgtcttctactaaagcgttgaatcagtcgcttctcggaatttgatgcctattggaacccgaatgctgttgtggaacaagtaagtaaaacagttccgagtcgtgccaatctcgggccggatggagtgagagtgcggaactagagcggtgctggcaaaaaccgagtcgctgtgttgtttcgtcggatgagcctatttggtcgctatatcagtctcaacggacacttatcttgacctgtatcgacttacataagcaatgcttgatacggaattgtatacttcatcttggaatattcgtcagagagagtctatagtgatgagatcgggagtgactaaggtatcactgaatctgagacggttctagtcagaacaacgtaattttgtcacagtaaaaaaggctttcagattttcctaccaagatacttaaatgtgttttatctgagtgattctgaattttttagccgagggcagaaaatgtttaaggaaaggaatatcaaaaatgaatgtctatataccctttattgagatggtttgtatctgggtgggcgcttctacaattatttcaattctcagaggaaaacagaaaaacaagttactccaagaaggcaaatatacaaatgaaagttactcagaagctagaaagaagatgcaggagcttaccacaaaggcgtcaaatcagctttttaatcgtgcttataacatcattattgtttggtattttttcatcgttgtgttttcgttgggagcaataacggcgaatttttcaattgcgccggttatttacttaattgatgcgatcttcctttttgcttttgcagttattaatcttggtgcatcatattatactcaaaaagtgaggagaaaaataaatactgagctaccagaaattaagtgtgcggtgaagatactactttttatttttcgggattttggcacggcgttagtatttttggtttcttatttgcaggcttaagctgactatataagtgttgcatagcgttcatttggaatgtttttgtcagcgttttttacatgaatgatattggtttgctacatgaagaggacaggtcataattctatctaaaattttgacgttgattaaaacgcgaaaactggggtggaataaactattaaaaatagttccaaacctcgcaaaactgcacatgtaatttcaatgcgctgtcacagcgttccagccccagctggccagagattgcgagggttggcacggcctagaacgcttttgtcgaccgatttttcaataattcggcgtttcagagggtacactgcacggtcaaaaattgtggtgcggcctcaaaaaaaaaggcacgccagctctcgtcggtgtgccttcctttttaaaccttgacctagtcagtcaactgaaacatcttaggaatcgaaagagaacctcacataaagaatatttccgacttaactgcatctgtatatttatttacctgttaatcgtctatttggtctttttcccctttaatgccgcgcaggaacgttcctacagccccgcggtctacgcctctagatatacttggtgagtaatagataacctcatcgttaagacgttggaagaacaagccttttcgtccatacaagttataaaaatagacagttcttggaaatgtgctttttgaccagatcaaatggtaggtcttgccttctaaatgaactatcgtatcatgctcattccaaaactggataacgttagtctgtccaaacgtagaaagtgatgtttgatggacactcatattaaacaaaaacaggctaacatagatacaaatataggttaaaataacttgtagtcgaggtcgctttacctgtttagaatttagacggatttcccacagagtcagagctaaaaagagactaaacatacttagacctaagatagtctgaaacatcgtccaatttgcaaaggcaagtgacaggaaaaaaagcacaagaactatcgacattgcatataagtgtctccagtaaaccatcaaaatcgcttcctctagcaagtttcgtgttcagtctcacaatttattttcattaatgttccaagtgaccctggatcatatttttaaatacgcttgctgccatcgttgcttgatcaggcgaatacgagacttcgaatttatccttgaaagcattcaatgcattgccaaactcagccgtctgagccaactctccatcgggatttaaaactcgaagtgcatctgactcaattttatcatgattgccggagaaccggtttgatacatattgattaaagcgttctgtattccccttgttgttgtaatatctgtcaataatcgaatacagggaggcattcccattttttaagctggcatagatattgactgcatccgcatcagctaacaagtcgcctactccaaatgagctttttccctttgatgcatctttgccaatatgatcttccattgcaacaagtaagttggcatatttatcagccgacttaattgaatccgaaatcccggtcaataaatctcctgcccatccagcaagatcttgtgtcccagttgctgaaacggcagcattaaaattcaataagctagctaatgctgcaatcatatgaatgaagtcggtcttaattcctgtcgcagtatcggtcaattctggaaaatcatcgtcgcttgtaatattccattttttgttttcattgtatatccatgtgtcattcagtgccccagtcataattgtccatggtaagcttgcatacctaaactgccgatacaattggcaaattaaacgtgctgccatcagtgaatctggcacagtgttaccatttttatccatattcttgacaaatgaatcggcgtcatcttgtacctttttcaggtagttaaagaactctgtatttacctctttcacagatgaactaacatgcgaaactccttgatctttgcccgggcttgcatcttggtcaatgctaatgccatatattgggtattctacgaactgatcgaatgcccaattacttggcatcttaaatcctaggttaccgctccagccatattctgagcacttgttttttgcgatttcataaagagtgctttgacggcgatcctcaaaaaaaccgaaccaacaaggtggcgtcggttcggttttccatcagtcgcgcttaacgacaagcttaattgagaggtggttcttatggtaaaggactataaagtggtcttttaaaagataaattgaggtaaataataaggtgtgacagaactaggtatgccattggttaccgcaagaattgtaaagccgtatacaatcagcataaacatgatgagcataaacaagtagctttctctttgtcgttgcaagatgcttgatggcgtccagagtaagtcatctttgttattaccttgactaatcaacgttaagaattggttatattgataccaccagattattgctgctagagtcccagcgacacttgcgcaaattaacattgaatttctgacactgtctgattgactcaggaaccaaagatgagtcaggttgacgggaacaagtttgaaaaataggccaaattggatacccagagcacaggcaataagcagagtagttgttatcaacaatacagtcgaaatggttcttaacgttttgagtaaacgatgttgcatatagactgttttgaagtaagaactgcgtgagcggtcgatctgtttttttgacatgtgcggatgtttttcttgttgaagggaaataactctttcgtttccaaccttgatgattcgtattggcattagaaaaacagtgataagaaagagcaagataatgagcaaaataaattcccctttttaattgaattcaggctaatccaagagccgctaatactgcttcgctaccacctgatgctccggctgccgctcctagtccacctgtaatccagagtaaaagtccaaaagcaagtactgtcagcgcaccctttccaagggtatttaatatttttccccagtcaatataattagttgttggccaatcatacgtttcaggattaagctctagttttatagtcaaggagagctggtctgtaagtgttttgccgtttagttctgagatgttaaaaataactgataacgaaatagctccatttgtcgctatctcagtctcaaccgacattttacctgagtcgatttgcgtaagcaatgtttggtgtgaaattgcatctgaaagaaaatgagtgacttggttatttacaccaatgttactaagagatgatatatagtttgtccagtcaatattgtccaatttgtgattttgaatttttatgattgaataatcatccggggtatggaattcttgatctaactcaatgctgattaaaagacctttgacatcaaggatagttaaaggaacattgaaatcccaactaaccagcccaagaaaacccattaaatagttcttagcccactcaatagattttgaattgccaggatcttttgaagtgtgagatacacctttgtctttgccggacgatgaaatttggtcaatatctgtgccgtaaatagaatattctgtaaattgatcaaacgcccaatttgttggcatcttgaatcctaagttgccactccatccataggacatatttgctacgaagctataccgaattccaatcttctcggcgtgcagacaaacatttcgcgttccataaacacctgtattgtaaattgattggctaagaatgttttgaatggctttaatgtaaggaataaccgtcccgtcaatatcgccttcttggaaatcaacatctacggcgaaatagatgacagttccagctggtagttctaggtttagagcagtcttgatagccgtttgagcatctttctggccttgactcgcagtgaagtaagtttcaacgtatccaccgtcttcgtaaattggaaagaacttcataccgccatcaagaatcgttttgatttctgttggggttaggttctttggtttaaagtcagtaccgactgtgcctgttagataacgaccgacaatgctaaaaccgtagtctcgaaaatgtttaacatcttctgcggtcaattgcgttgctgtgtctaatgcgatggaatcacgaccggtatcaccattgctggtaactaggcccttaataacagtgtagtcagcgatgccggaagtttcgttagggtatttcataaacttccggaagcgaatgatgctggtggcgacgtcgcttccaaagctttcactgaagtcaccgctgtacatgctatttaaatacaaaccatatttgacgatcttgactaacaggccggttgatccgactgatagctggacgttctttaatgcagcattggtggcatcaccgaaattaccgtttgcaacatcagcggagatactcacggctcgctgtaaggcgtaaatcaaaccaacatttggctgactaaaattgaaataattgaaagatccgctacaactttgcatattagatttcggttgcaacccgcttagtaaatagtacactaacattaatatactaaaagcggagggaacaggatgaatgatgagctgacgattcgaagcgggattcgcgatgtgatgccgacagtgtttgggtacattactgtcggaatggcttatggcattgtggcgaaaaccgggcatttgtcgctgctgatgatcgggttgatgtcgctaatcgtatatgccggatcagctcaatttgtgttggtgagtatgttagcaaccggcagtccgattggggccatggtgatttcaacggccttgattaatgcgcggatgagcctgatgtcgatgacggtcgctccttatttaaaagatgaatcgatgactcagaatgtgctgatcggtaccttgctgacggacgaaagctttgcgttgtcgatgaacaagcttaattacaccggccatcatttaaatgctccctggtttcataccgtcaatgttggcgcgtacttagtctggtttattgccagtcttttaggggcggtgattggtggcttgattcctaatcctgataattttgggttggatttcgcagttgttgcgatgttcatcggtttgctgtacttgcagatgattacggatcgatcgaagccttttttgcggcatttaagtgtggccagtgtcgttgccgtcgcgatggtggtgctggtgcgttacttgccggggacaacggcgattattgtcgcaactgtgattggctgtctgtttggaatgggggtggaacggcatgcagaatcctgaaacatttgtggcgattttgagttgcgggctggcgacatggttattgcgggtggtgccgattgtcttggtaaaacgcatgacgattcctaaatggctgctgcattttctcagctttgtaccggtggcgattttatcggcaatttttgttgaaagtctcctagtgattcaccccggacaatggccaggcgtcaactggtcgaatttactagcatcgctgcctgctattgtcgtggcgattataaccaaaagtctctttgctgtcgtggtcgcgggcgttgctgcgatggcgattttacggctgctagggtgggcttagccattatggtcatcttttaaaaaaggtggctttttttattttcttgatagcagcaaaactttgatttaacgggcatcaggaaagctttcttttagtaaaaataatagcttcatattgggttaactcatatatcagaatttctagtgccaaataaaatagccattgaaaagttttactaaaataagtacactacaaggtgtaagcgatttcagaaaacgtactctttaaaacttgaaatggaggctttttgcatggagacatcgttgttatacccagtgaccaatgatcagcgcacggatcagaaactggatggactttggcaatttaagtttgatgaagctggagaaggtgaaaagtccggctgggagaccggttttcacgatggcgtttcgatgccggttccggctagtttcaatgacttctttacggataaagcaagtcgtgaatataccggtgatttctggtacagtcgcaacttttttgtcccttctgcggctaagggaaaggcattgtttctgcggtttgatgcggtaactcaccgggccacgatttttgttaatggcaaagagattcgaacgcatgaaggcggctttttaccatttgctgccgatatcagcgaggccgttaagtatggtgccgaaaataccgtggttgtcaaaggtaataacgaattgtcgcgggaagcattgccggccggggatacgattacactgcggaatggtaagaaaatggtacgtccgttctttgacttctataattactctggcttaaatcgctcggttcacttgttgtccttgcctcaagagcgggtgttggattacaccactacttttgcgttagctggcaacgatgcaacagtgaactatacggttgaaaccaatggcgatgcgccggtaacggttagtctggcagacgcggatggccaggtggttgcgactgctcaaggcaaacaaggcgccttacaggttcaaaacgctcacctatggcaggttcgcaatgcctatctttatacgctgacgattcagcttggcgatgatacccagacaccgcttgatacttacaccgatcggatcggtattcgcacgatcaagatttccggaaccgatattttggtcaacgacaagccgatttatctgaaaggctttggtcggcatgaagattcaccatttgctggccgcgcgtttgacttaaatgttgaaaagaaagactttgccttgatgaaatggattggcgcaaactctttccggacatcgcattatccatatgacgaacaggtttacaagatcgcggatgaagaaggcttcctgctgaccgatgaagtaccggcagtcggctttaaaatggccgccgctgcttttcttggcgggctgaaccagtccttcttcaaagggccatggctcaagaagctgcatgaacgccatattgaccagattcgtgatttgatcaaacgcgataagaaccatccgtctgttctggcatggagtctgtttaacgaaccggatacaattgatgaaaatgcggtcccatactttaaacagatttttgacgaatctaaagatcttgaccctcaaggccgcccgcggacgtttactttgagcgaagatgatacgatcgagacgtcaaaagtactcgacttcccagacttttacatgctcaaccgatatcctggctggtatcattttggcggctatcagatttccgatggcgaggctggcttgcgcgatgaaatggataagtggcaaaaagcaggcgttaagaagccagttgtctttaccgagttcggggccgacaccgaagctggcttgcataagttgccaagtgtcatgtggaccgaagaatatcaagtcgaagtgctgaaaatgttcagccgtgtcttcgatgattatgacttcatcaaaggcgaacaggtttggaatctggctgacttccagacggttgaaggtaacatgcgggtcaacggtaacaagaaaggtatcttcacccgcgatcgccaacccaaagccgcggcgttcttctatcatgatcgctggaataagctgccgctggattataaagcaaagtaagttttgggtgaaagtatcagcagtaacgaaattctaataataacgtcgtcggtgtagacgcagaataccaatcttggctgtccgtaacgggcggtaagattggtatttttgcgtgcgcgtgaatgtctaaaggatggcctgacttaatccccccaaatatcagcaactattttaatcgacagaagattgacaaaccctgcttaaataggccgtaatggcaaacaattggcctaaaccattgaaaaacatgcgacaaatttggcaaaaattattgttgttaacccttaaacatgtatactaatatatgagtttaacaagtaagcgcattcagtaagtgcttttatgcacggttactaaagggggtgccgcgttcaggcaaaaaaagcaatcggtaaacgcagacggaacaaagacatgggaggcaaatactcaaatgaaagcaaagctgattggctcaaaacctaaaagcagcagatacagattgctttggtccggtattgtcatggcaatgatggcggtatcactggtaatattgctgacaatacccgctgcaacccgcgctgcatcgcaaaacccggaagacacggttgccgttcatctcgatgggaacgacattgcttcaaacaacaccaacggcctgacttttaagggcttcggtgtcctgagtggtaacggtactagtgcgctgttaatggattataaatccgaacagcccgatgtttacgccaagatgatgaagaccttgtttggcggcagtcaacccattatgaccaatctcaaactggaaatgggtaatgaccgcaacaactccaccggttcggaaccggccacccaacgcacggaatcagaagctgccaatgtgacccgcgatcaagggttccagttagtggcagatgccaagaagattaatcccaatctgaaggtgacaattttacgctggaacgcgccgggatgggccaaaacaaacgatcagatttacacttggtacaagaactcgattttgaacgcgtatcgtacatatggctatatggtcgactatgttaatccgggattaaatgagcataagccggatctagcgtgggctaaagaatatgcagagcgcgttaaaaccgataacaccggctttaagaatgacacagaacgtcaactttataacaagatcaaagtggtcatttccgatgaggtcggtgttggtagttttggtaaggatatggtcaccgattcatccttacgaaacgcggttacggcagccggctatcactactcaaccgaagatgacagcgctaagaacttcacggcacttgctgataagtacgacaaggaagtgtggaatagtgaagctcaggccacttttggcaactccgactaccggcctaattcaggtaccggaatcggtgtagcaggcagctcattagaaatggccaacaccattgtgaaaggttttaccgattcacggcggacgaattttatctaccaaccggcaattgcagctttctatgaaggcggtcaatattcatctaagagtgtcctgcaggcaaccgatccatggtcagggtggacgaatagtgatgttgcgattgatgtgcttgcccaattcagtaaatttgccaaacttagttgggaaaatagcgacaatacgtctggtatctggcgcgccgtatctcaggcaagtgtttccacggcaacgggttccaataatgtcaacggccgcaacggtttggctaactatttaacccttgcttcaccggataaaaaggatttttccacggttatcgtcaatgatagtaagtacacgaagcactatcagatctcggcttccaacatggcttataaaggaaccccgacccttgaggaatgggaaacacgggcagctgacacgactgcaaaagatgcgtatgacagcaattacctcaaacatgttggtgatgtccaagctgatagcaaaggtgtttataccgttacggttaaaccattttcaatcaagacggtcaccacgcttgataaggcaaaggattccgatttgaaccaaggtatatcggcttcatcgaacaagcagcggacggtacttgataccgatgccaatggtaaagggaccgacacctcagacacgaccttgtatgcagataattttgaatatggcggtaagaaagttgcaacgctgaatgctgatggcaccagcaacaccgcaaagactgaagacttcataacatcgcgcggtggtgacgaaggcttctatccgttgtatacatttaatcgtaatgggacacttgaaggctacaagacgacaaatgccaagtcaggtcattacgttttacgccagcagttggactcaacggtggtcgaaccgggcggggcttggaacgatggcgatgcgttggcatggatcggcgacaatcgctggatgaattacaaagccagcacggatgtctcatttgaagataaaggcacccatggcagcgcaaattatgcttcgatcggtgcacgtcagcaggctgattcaggcccggcagcctacctgaaattctggcaggatggcggctggtcattgcatatcggcagtcagtcagttgcaagtggcaatgtcgccactggtcaaggcggcaccaagatttccggcttcgatacaacgaatacggcttggcacaatattgccattcaggcagcaggcaataccatcacggcttccattgatggccaaaaggttgctgatggcaaggtcacgtctgagctttccggacgagttactttaggcagcggctacttccacactgactttgataacctgaaagttgaaactgtcaaaggctataccccgtactactcgcaacaaatcgatgacttagagatgtacgacacatctgccacaccaaaacaacaactggtttataacgatcagtggacgcacgaaaccgaacaaggtatgtacttgcgggaccggacagtttccaagaatacaggcgccggtgctacccttacgtatacgttcactgggaccggtctggatatttgtggcaacaatgatggctcagtgaagttggatgtgacggttgatggcaaacaagtcgcaacagatgctgcaaccaacaaggccgacaatctcgggcagacctacacattacgaaatttgaagtacggccagcataccgtgacgttcactgtcaaaagcggtacgttagcagttgattatgtcggtgtcgtcccaagtgacaccattgccgatttcagcaagctgcaaacggcttacgataaagtcaaagatgtcacgaacgccgataacaagtacacgtcatcaagttggacatcgtttcaaaaagttttattagcagcaaaaaatgtccttgcagacacgacggtttcacaaaacgatattgatacggccctcaaaaacctcaacacagcatatgccgccttggcgcttagcccagacaagacaaaactacaaacggcttatgataaggcaaaagctgtgactaacccaagcgataagtacacggccgccagctgtaaagtattccagaccgcattaacggatgcgcagtacgttctcgctaacgccaacgcaactcaaaatgatgttgacagcgccttgaagaatctaaatcaggcagcctctgatttagtgctgaacccggccaaaccagataagacgaaacttcaggctgcttacgataagaataaggcggttacgaacccagacgacaagtacacaagtgaaagttggcaggcattccagacggcgttatcagatgcgcaaaaggttcttaccgacaccaacgcaacccaaaatgatgtcgacaacgccttgaaaagtctgaaccaggcagccactgacttaacgttgaacccagcaaagccagataagacgaaacttcaggctgcatacgataagaataaggcagttacgaatccaaacgacaagtacacgagtgatagttggcaggcattccagacggcgttatcagatgcgcaaaaggttctcgctaacaccaacgcgacccaagacagtcttgatacaaccttgcaaaaattgaataacgcttatgctggcttaaagcttaacagccagaaaccagataagtcggcactacagacggcttatgacaaagacagtacagtgaccaaccaagctaataagtacacgaccgcaagttggacaaccttccagtcagcacttgctaatgcgaaaaaagtgttggcagacactgacgcggttcaagcagatgttgatacggctttgcagaagttaaatgatgcttatgacggcttaacccttagcccagataaatcggcattgcaaacggcactcacagaggcacaaacgctcagtcattcagcagtaactggcgaccacgaaggtaactacccagcagatgcgcttaaaaccctccaggttgcgatcgacaccgccaagaaagtcgcggataaccctgatgcttcaaaagatgatatcgacactgcagcatcaacattaaaacaagcggtcacagcctttaaacagaccgttgtaaccgtcagccgcgaccaactgactcagctcgtcaccgagtcgcaaaccttgcgtgccgatgattacacccaagacagctggacgccttatcagcaagcagtagcagcagcacaaaaactgttagcaggtaagccgagtcagcaagaattagatgcagccgcaaccgcactgaagaaagccaaaaccagtcttgtcgcagcgccaacaggtaagctgccatcaacaggtgatgcttcatccgaaagtgccagttctagcgaagaaacagcttcttcatcaacagccaagtatccaagtacaggtgaagcacagctgtcactggccgttacgatggcagcagtcgttttcctcattggcatcagcggctttgcatggttcttacaccagaaagggaaagctaaataatcaagcacgtaaagcgaacgactagataagcttaagacccctgactatggaagatcaaaactaaataaagaggctctagggacgattgaagtgtccctagagtctctttttggctgatggtcaaaatatagagatgaaaaatactggaaaaagtgtcgcagccatctccaaggtaatgactacccaaaattgtcagcaaacgacgcttaacataccaagaatagtatttggagatataactaaaaaacacttgccgggagtgtccttcatggcaagtgtttttggtagttaacaaaagtagatcagtcgtttatggtgatagtattttctttacttaccagcccgaatggcatcaagcttagcccgatacttcttagctgtagcagtgacgccggcatagtcgccggttttggctgcggcggtgaggttgctgccggcaccgactaaggtaacgccggcatcgaaccaagtttcgaggttatcaagcgacacaccaccggttggcataatggccagctgcgggaatgggccgtgaagtgctttgaccatagccggaccagcaacactaccagggaagaccttcacgagatcgacgccggcttcaagcgcggtttggatttcggttggggtgaagcagcctggggtgtaaggaattgaataaaggttgcagatcttggcaacgtcagcattgaagcttgggctgacgatgaacttggcgccggcaatgatggccaaacgcgcggttgcaggatcaagaaccgttccggcaccgatcaggacgtcttcacggtcaccatacttttcactgagttcatccaatgccttgtcagcatgcgggacggtgaaagtaagctcaatacccgtaacgccgccagcaatcacggcatcaacggttttgaccgcttcatcagcatcgtcaccgcggacaacggcgacacagccggtgttaattaagcgattaagatagtcatatttttgcatgggtgttttttctccttagacgtgttctgtagtgaagaaaatcaaatgggatgcttaaaagaattgagtgtctcacgcgcgctcagttttattaagactggtttgcatgaacttgtcaagctgttgtcgcgttgggtaaccggtgttgtcgccaggtgattgaatcgctaaggcaccgatagcattaccgcggctggctgcttcggccggtgagcggccttccaggatggcgctgatcacacctaatgcaaagccatcgcctgcgcccaccgtatcgacaatgtgttcggccggaaaacttggcagtaactgtccaggcacatcacggcctaacagatacgcaccttgtttaccgactttgacaatgaccagctgcgtttgctcactttgattgagatagaagtgagcgatggtttccggatcatcactgccgacgagaatttttccttctgcggcacctggcagcacgatcgatgcacttttggccaacgaattaatcgttgtcaccatggtgttctgatcaggccatagtgctgggcgcaaattggggtcgaacgtgatcagaatgtgattgctgatcaaacgtttcatcagccgcttcgttgcagccagcgttgatgctgaagcggctgggaagataccggtaatgtgggcaagtttgacgccggccaagtcaatccgatcaatcgccgcgggatcaaaatgcgctgccgctgatcctgcccgcagatagtaggtgttaggatcgccatgcgtcacacgcgccttgaactcgatgccggttggataacgtgaagtcgtggttacattgtcgcaaccgatgccggctgctgtgagttgttggcgaatgaaaatgccattcgggtcttcaccgagatgcgtaatgtactcgacggaatggccgagtcgactcaatccaacggcaacatttaactcagcgccggccagatacttggtaaaatgtttggcggccgctaatggaacatctgcttcttcagcggcaaagacgactagcggttcaccgattgtcaggcattcattcacgtgtgatcgtactcctttaagcgtttaatcgttgttattgtcgtagaaaccaaagtagtcatgcgcgttcccatagctgatattcttgataatccggccaagggcatcaaggtcatatggtactcgaccctgttcaaccagttcaccatagaagttgcacagtacccgacggaagtattcatgccgcggataagacaggaaactacgcgaatctgttaacatgccgacaaagtttggtaacaggctttgttgcgcaaaagtctgaagctgccgatgcatcccttcagccgtatcattaaaccaccaggcagcacctaattgcaggtgttgtttatcgccttggccaacgaagctttgtaacatggtgatgagtggtagccaatcatttggattcagggaatagaagatcacttttggcagtgggccacgcgcgtccatcgcttggaaaagatcccgaaactcgccgaccaaatcaggttgactgcccatcgcatcgaagccggtgtcgggaccgatctttttcaagttcggtaagctgagactgcgatcaacattggcatggaactgcatcgtccagttgaactcccggttgagatccatcagcatttccacaagtccggtgagatactgatcattttcaacatcactgactggccggttttcaatgcctttcttgataatggtatcaagtgcttcttgatcgactgggcggtagtggaagctgttgaggccgtggtcagaaaggtggccaccatgctcggcaaagaaggtgaagcgttgtttcatggctttcttcaaggaagcaaagtcggtgatttcaacgcctgctgctttgccaagggtttgtaagtagtcgccgtaagtattggcacagatcgccattaacttatcagggcgcatcgttagcaatgagttcgtggtagtgcaagtcgctggctggatcatcggtggtgcagacaacttcgacatgactgcgccgaatcaacgcgcgcggcgtaaactcaggggtagccagtttggcgttggtgagatcccagacctttttggcggtgtcacgactcaataccagatcactgccgaagaaacggcgcagttcgaggtgggtccattcaaacacagggttgccccaagcattttccatggttttgcaccaggcgacaaacttctcgtaatcatcgccatcgccagtgatgagttcttcagggacaccattagcccgttccaggcgccacttgtagtgatcgccgtatgtgccttcgtttaaccaaatgcgggtgatgttcttgaagttacgattttcatagatttcctgcgggttaagatgacagtgaaaatcaataatcggcaggtcagcagcatattgatgaaatagttgcttagccggctcattggttaagagaaaatcatcgtccaaaaaagccattactttgcgctccctttttctaatgcttcccagaggccgtttagataggtgatgcctaaagcacgatcgtataaaccatagccagggcggccattttcgccccagatgttgcggccgtggtcaggacggatgtagccatcgtaatcaaggtcatgcaaggccttcatgatttcgtacatatccagcgaaccatccttggaaaggtgatcggattcgtggaagtcgccttctttgttgatgaacttgatgttacgggcgtggataaaaggtgcccgatcttttttgacaaattcacggatgatggctggtacatcgttgtttggattttcgcctaaggaaccggtgcagatggtaaacccattgtaccgagattcatgcatgccttcaatgatccgcatgtcttcagcgttcttgtaaacccgcggcaagccaaagagttcgcgcggcggatcatccgggtgcatggccatgcgaacgtcatacttttcacaggttgggatgatggcatcaaggaagtacttcatgttctcgcgtaacttagcggcatcaacgtcagcataagctttgaataagcgttcgatttcagccagacgttccggttcccagccaggaagaacatagccttctgagttgttacgaaccgaatcgataatatcgtgtggatcgtcttttagatattgatgttgaaaggccatgacattgctgccgtcttctagctgatagtggagattggtccgcagccagtcaaagatcggcatgaagttgtagcaaatgaccttgatcccatattcggaaaggttcttgatggtttccttgtagttttcgatatacttgtcgcgtgatggcaagccaatcttaatgtcatcgtgaatgttgacggattcgatgacttccagttttaagccggcatcttcaacttgtttcttcagtgcggcaattttttccttgggccaaacttcacctaccggaacatcgaaaagcgcaccgacaacttgttgcgtaccgggaatctgacgaatttgctgtaaggtgatggggtcatctttttcgccgaaccagcgaaaacccatttttaaatctgacataaattaaagctccttttcatgatcttgacgaaattgttcaagggtcttagtcactgcacctgggccggcaatgagtttcttgaagtcggcttctacttggtcagccaaaccgatttgataaaggtcgtggccaaagatctgggcattgctcaagattggcttgagtgcggcgtggacatcggcatcactacctaacttgatgtcggcaacatatggctgtaactgatccaataatgggtcgcggcttggggtgaagtcgttacctttatcatccaatgccatcaggtaacggcaccaaccggcaagaatgagcggaattgccttaagctgcttaacgctttcaggatccttgtccaagtagtgctggatcgtcacgccataacgaattggcaatttctgggacgtgtcgctggcaatccgttgcggggtatcgggaatattcttgtttggcaagcgcttggtgaccagctgatccagaaacttcttaggatcgataatcttaggatccttcacaactggcagatcttctttatagccaaggtacttgatcaaagtgagcaaattaggattttcaacttcagcagcaattgacgtgtagccaaggaggttaccataaatggccaaagccgtgtgcaatggattcaagcaagcggtgaccttcatctgatcggcatcgttaacggtgtcgcgatcggtgaggatgacaccggcattttccagcgccggacgaccatttgggaagctgtcttcaatgacgaggtagtgggtttcttccgtattaccaaatggcgcaatattggtgtgcttaggtgtgtgcacgatggtggtgtcttcaaaaccttctgccttaagtttgtcggcaacgttttgcgccgggttcggtgtgatccgatcaatcatggaccatgggaagctgacttgcttaggatcggtcagataatcgatgaagccttgggtgaccgtcccgtgtttagcccagcccttggcaattgtcaaaatgccgtcttcataacgtttgccgttttcagagaagttgtcagtgctgaccatggcaattggcttggcaccggcttcgtaacgtgccaaaagtaggcgcgcaatggcccccatattggtcgtcgcatcatctggcttacctgcgatatcagcttcggcagctggtgtcagtttgccgttgatatcagtcagttgatagcctttttcggtaatggacatcgtaacgagttgcagtgaaggcttcgtgaagatttcttttaaatgttcccagccttcaggattggtcttgttgtagtaaatcgcttcggcaacactggctatcagtgtcttatcaagtgtgccgtctggttgcataaccacttgcaacacgcgatcgttatatggcttgtagatatcggcaggcacatcgccatcataagtttcggcaacaaccacaccagactttaagctgccattattgagcaagtcctgcgcaatcttggcatgaaagcagcggaaaagattgccgccgccgaagtgaacccatacaggattggcctcagttgtctgtttcatttgttcttggtcgaattgcggaacagcgataccagccgctttgaaatcagcagcctttgcttgataatcgtcggttagcttaaccaaaatgatgaacctccttatatattaatatatcagtttcacacacttaatatagcacgtgcgggttaaaatggaaagcgctatcagaatacttttaacattttaatccaaaaaatatttctgtataggctctgaaccattaaaaaggaaaaagtcgaatcaacaacagttatccgcgttgtttgattccgacttttccgacgttatttcttgttagcattcacacctttgctagaaaacctgtcatccacaatattagcagataggtgagcatacgctttctgttaattaacgaacacgtttgatggcggcaatcaagaagccaccgatgatttccattgcaaccgcgaagatgaagactgcctgataaccgaagccttcaacaatagcagaagcaaccatggcaccaagcatctggcccaacgtgtttgctaagttgatcagtcctaagtctttaccagcagtatcagaagatggcagcacatccatgttcaacgcgccatcgactgagttgtacaagccattaccaaaagcagcgataacagcgtaggcaaacattgcccaagcttctttgacaaacaatgggaacaaagcagctacggctaaggcgaacgttgcgataacaaccggacccttaacccgcttcattttatcggcaagtggaccgccaactaaagcgaagaagacaccaatgactaacatgatggttgaaaatacagagatggaaccgccagcttgtttggtgctttgaccaatatagtcggtgaagatgaacaaaaggaatgtggtaacaatcgtagaaccgacaaccatcaggaatttacctgacaaggcgagataaaagtcgcgcgcatcatgggttgggaagaagaagtacttcttgagtgattctttgtcgagcttgatctttggttcgtccaggttgctcttttcgttgatcaacagaacgtggataatggccaacacaacggtcatgcttgccatgacataaataccgaatttaacattgccaaggaattgagcggctaacagtgcaaaaccttgttgcgcgatcgtgaaaccaacgccgtaaaaggttgaaacagtgccacgccatttaggtgcaacccgatccgatatttgcggataaatcgctgcggcaatcgcgttttcggccgccgccgcgatgatccagatgaagatgatagcagtaattgaagtcgtattagcaatggcgaccagtgaaagcgcgattgctatggtaccaaggacaatataaggtttccgcttaccaaaacgggttcgcgtcacatcggaaaaagcaccaaacagtaagttggcaatcgcaccggtgatagacgcaacggttgccagaatgccgacagcccaaaccttgtgtgccgaatcaatttgactaaatagttgtggaattaaaacgcttcgggttgaaccgattggcccgtaccagcaaagtggcgcgaggaacattgcagttgcaacaccaagtggcatctttggctgctgtgaatcttgaatccttgcgttggtaacaaccccaaccgtcgttttgaccgctttaggatcgttcttaacatcatttgccatttttttcactcccatgaaattaagtaagtgcattaaaaaataaatagatagaacaaatgcataaatgccggaacctgaattttgacacacccgcctccttgccaatcagcttatgccacttaaaacctgattggtcacaaactgcaaccagttgtgaccttaatggtagatatacaaccagtcagctaatgttaaaggcgtattttttaaactaaacgcgcgaaaacattgacactcggataactgatatattagtatatccttacaagggcatgatagcgcttaccgaaaacggtgtcaacacctgtcaaaaagttttataatttatacgtctcaagcaacatctttctcgaaaggctggggatgttatacaatcagataatcaggtgaaaaagaaggaagggtgacgcccatgcaaatatcgaattatcaagatgaagcatacaacgctatcaaggagatgattctcagcatgcagctgacccccggggaaaaagtcgacaagactgaattgagcgcgcaactcaagatcggtgcgaccccgatccgggaggccattatccgcttacggcgggaaggactatttaatgtcattcctcaaagcggtacttatgtatcaaaaatcaatctggatgaaatgtatcaaggccggtttgcccgggtcaatttggagcggacgattgtggcggacgcagttgatgtcatgacgccagatcaaattgctaaattggaacagcaaattgcgttgcagggtgtttatgagcattctcgggattacgatcatttttttgatcttgatcacgactttcatgaaatattttatatggccgatcataagcagtttatctgggcttgggtacagcaaatgaatttgcaatttaatcgctaccgatacttacggttggaagttagcggcttaaaatggcataacattatcacggaacatcaggcaattgtcgatgcagtcaaggctaaagatgctgagttagccagtcatttggttgcggatcatttgttagcgattgacgacgatgttaaggcagttttaagtgcctatcctaactattttgaaggaaaagcagcgccaagccatcagcctgactaaggtgacgctgttgtcagattttgttcactgtaagcgcgatcgtgcccaacgaaaggaaggcttacagatgacaaaagtattaacattcggcgagatgatgttacggttgaagccgtatgatcatcaacgtattcttcaagcgtccggcttcgaggccaattatggtggctctgaagctaatgtggcggtttctttggcattgcttggcgacgaggcgcagtatgtcaccaagctgcctgataatgcattaggcgacactgcgcgcaacaccattcgtggtctgggcgtagatacacataagatcttgcgcggtggtccgcgtttagggatttatttctttgaaaaaggggccagtgtgcgcaacacgaatgtcgtatacgatcgtgccggcagttcgtttgcgaccgctgaagctgatgaatttgattgggccagtctgcttaaagacgtggcctatttttatttttccggaattaccccggcgatcggcaaacatatgcagaccgccattgaatcagccgttaaatactgtgccgcacatgatattaccgttgtttgcgacatgaattatcgcggtaaaatgtggtcgcctgcagaagctcaggcattctttgccaaggtcatgccttatatcacgattgttttggctaatgatgaagattttgaagcaaccttaggcattaaggcatttgatggtaacatggcgaccgggattgatcagatcgccagtttcaaggctggtatgttgcaggtaatgaagcagtggccgaatgttaaaaccgtggccagtgttgtgcggaacattcactcggtggaagatagctggtggacagggcttttggccgaagatggcaaaacataccaagggccaaccttccacatgcatgtgatggaaggcgtggcgtcaggcgatgcgtttggggcaggtttgatgcacgcgacgctccatgactcgcaggccaagatcaattatgcgatttcagccagtgtgttgaagttgacgatcagcggtgatctgaatttgattacggatgcagacgtgcaggcggtcatggcaaccggcagcggtgttgatcgttagtcgggcaagaagaaagtgaggatgcaataacatgcatacgttgacgattgatggtagtcagttgcagttagagcaaaacgaagccaacacaattaaaggatttggacttctaagctgtaacaatacatcaaggttattaatggactacaagtgggaacaacccgaagtctatcagcaagtgctgcaacatttgtttggcgggcaacagcctttgatgcgcatgctaaaagtagaacttggcagcgattcgaatacatcatgcggcaccgaaccggctcctcagcgtgctgcggacgaaccggctaatgtggcacggggcatggggtttcagctcattgccgatgccaaaaagattcagccggacttgaaaacctgcatgttgcgctgggcagagcctggatttttacggccaagttggcgccaggtgaagtccgatgatcctgatgaaaaggtgccgacagaagcttttgaagccatgtatcagtattacaagcaaacggtgattgcggcttggcaggcatatggttatctttttgattacattgatcccgaccgtaacgagaccaaacacccgatgtatcgctacttaaaatggtttgctaaccggctgaaaaccgatcaggctgatttccctgaaggttttccagtagcagattatcatgcgattaagttgataacgtcagatcaaaattatggaaccgacatggggacagcattgcttaacgatcctgagttacaagcggtgattccggcagttggctaccattacaacaccgatgacggtccggacaaaccatttacgaagattgccgatcagctgcataaggaagtctggtacagtgagggtattgcgccagtcacattcggcacgcttaggacacaagatactactggcattggcataggcggtccaatgagtgctttggatgttgccaatcgtctggttaaaagttatgcccgctcgcgtcgaagtttatacatttttcaaccagcgattggcggcttatatcccggcgcaaaatatccgggaaagcaattacttgaaatggatacgccgtggtcgggttactttcagcaagatacggtggctttggcggtcatgcatcacttcaccgactttgccgtaacgggatggcgcgatcaaacagccgcaaaaaactggcggtatgttccgagtgccacggtaagtgaagtggcggggactgaaaatctgacgcaggcgtttggagctgccagtgtcatgacgttagttgccccggatgaaacggactacacggtgatgctaatcaacgacaccagtgctccccaaacctatcagattacggttaagaacctagctgctgcaactaaaccgctatacgtatggcagacttgggccgatgatgccggtaaaattcacgatcgcgaaaagacaaccacgctgacgccggttaatgggaatgtaacggtcacgattgaaccgcgagcgatcatcagtgcaaccaccacggatttccagccacaagccttattacctaatcctgatgttaagactgatcagccactgcaacaggatccggaaaatcacgttcttttccacgatgattacacctatgccgatatgccggctgattatctcacgcgccgtggcggcaccccgaaatatacaactgacatggatggcgcgtttgaagtcgttgagcaggacggtaaacgcgggttacaacaaaagattaccgagcagtcgcgggcattggcttgggaaacgcaaaccgatccgaactttaccgttggcgatattcgttggttaaactatgcggctgcgttgaagtttacgtttgacacgacaacccggcaaaatactgtcagtgccaactatattggccttggcgtgcggagtgtggacgattttgaaggcagtttattctcggcgccatatgtggctacgctgacagttggtgggaagttacgcttttacgttcgcggtgctttggcagccacacttgatgtgccggttttcgatgccgaagtgagtcacgaacttattgttgaagcaacagatcgccatgtgacggtgcaaatcgatggccagacttatgtaacttatgacgatccaagtgatcaaccgggtttggccgggcaagtcaaagtcggcaccggctatttcaagacggtgattcaggctttgacggtcacgagtacgtcagcaccagcggtattaggacatcgccgcgatgacttagatgccagcctaacgtttagtgacgatcaatgggaacgccttgccgcacgttttccgcatgcgtgggaacgctcgcagtcaattggcgaaaaaggcgctaccgttgactttgatgttgaaggaaccggttttgtgctctttgggacgcaagcacacgcaagtcgcttgcagctggccgttgacgggcggatacaggaagtggtgccgttgactgcgttggccaagcaaccgaatacggtggtgactgacttggcagccgggcctcatcacgtcaaggtgacggtcattgatggcagttatacctttgatggtgtggcgccgattctataaatacccttgcttgaagagtctattttaatcatgatcaacacgttgaaaaatgtctggaaaatgagacggtttgagtccgatttccaggcgtttttgcgtttttaggaagtgatggtggcgtggcaaaaagcagcaacattaaccgctaaaatgacgttaatcggccaaaacccgacgtttatttgttagatgacaccgcgtgccggtttgcgggtattataaaggggaaaatgttcattgttgcgtagtctatatttgagagcgttaaatgaagttgctagcacagacagaaataaaagctctcagtcaacattcgaaagtcatgaggtgagaatgatgaaggctttatacaaaggtgaacctgctgatatttgggaaataggcaaaacgacgcctcagccagattgggttcgtgaagcgtttgaagcgaattacttgtattggttggataatcatctgcgcattttgatgagtggtctgaagccatcgctgggcactaatttaaagataggggctgtcggcacgatcggcggcggctttgccgggtatggcatgtatgtcatgggctatccaggtgattacttagatatcaccaatcatcgggtggtttcaaagaaaaagtttttgaagcagtaccagcctattgacgatacccgtgtcagctgaggatcagttatagcacaagacgatgggactcgagacaggttcaaaggcaagatcgcacaaaaaagagcatacttagatataattttttatgttatcctgccaatagaaacgtgcgtgggcgcgacctatgagcagcgtccacattcgtatcaagaatgaaaagaaagaagatcagacgatgaatgaaaagttcctcgaagtgttgaagcacgaaggtcctgttacgattgttaccatcaacggcaacccggctcacgtggtcaatacctggatgtcttatgtcagccgcaaagacgatgaactctatattcctgcagccggtatgcacagtatcgaaggcgactttgctaaggataaccatgttcttttaacgtttggttccaaggaagttgaaggaacagttggacccggcgccggtttccatgtgtttggtactggccgatttgtcgatcaaggcccggcgtttacagccaagaaggaaaagtttccttggttaacccgcctgctgattgttcacgttgatgaggttcaacagaaaatttagcagaattgccgggttaagcctaacgcttgtgtgtagacgaggcgataaccttgctagcaacaagcatataaatttatacgcggataaaaataagattctagagggagtttgcctcaaaggatctatttttttgacattaaaaaaacgcaatccatgatttacatggcatgcgttccgtaagtccatataaataactttagccaaacattcgggtgacatcattttgaagcgtgtaatcgccattgaaccataaacgttaacaaggcgagtaccgcgagcagaatgaagtcaatttgactgccggttgcatcggcgccagatggtgataggcgattttgaaacgtgatgatggctgacaagctggccgttcccagtgatccggcgtattgctgaatggtgttgaacaaagtgttaatgtctgctttagccgggccggataccatggtgctggcgtcggacatggtgttgccaaagcccagattgaagcccattcggaagatgatataaaaaccgacaattaagggaatgctcaactggtgagtgaagctgccaagtaaaacggcaccgacaaacattgcggcattactggtgagtagcaagcggcgggcgccaaaacgatcgtaaagcgcaccgccaatcggtgaaaccgcagccccgatcagtgagccaggcaatagtaataagccagccactgaagcgttggtatgcaagacgttttcggcaaagatcgggatgacaaatgcaataccgatgttgctgaattgcaggatgaagaagttaatcgcacgggcacgaatgccagcatttttgaatagcgaaaaattaagcaatggcgaatgggtgtgttttaagtggcgacccatcccgatgatggcaattataagcgcgacgacataagcccaaaaggcaccggtcacgccggcagccgtaaactgatccagcacttcgatcagtgaaaagagccccagcgccagcaagaggaatccgaggaaatcaaaacgatccgcagttggatgtgctttgacccgaatcgttgcttcacccatgaaccagacaagtaagatgatgggcacgacaagccagaaaatcatccgccatgacgcgtagtaagttagcaaaccgccatatgtcgggcccaaagccggtgccagcgaggtgaccacgctggccatgccgacataaatgccaagatgtgcttgaggaatcgtggtcaggataaggtggaacattaacggcgtggaaaccccggtagcaagtgcctgcagcagccgaccagcaaacagaatcggaaaattcggtgcccagatacacagcagcgtccccgcaagcgcacagcaaatggctgcccggaataataagcgtgtgttgaagcgccgcaataaaaaagcggtggtactcatgaccagcgttaccatcagaagatagcccgaggtcagccactgaacggttgataacgatacatggagagttttgatcaaggttggaaaagtgacgttcatagaagtttccaccagaataccgacaaaagtcagcaagccggcagataaaatggctaattgcgtacggtgtgaaacaggtgaattcgtcataaggttgccttcgtttctatcaattaacctgatgcagcatcaggtcactgacgacgatagcagattccaaaaatccgcgcaaacgcaagcggtttcatagggccaaaatgaggagaagcacggtgaatgaaagcagtttgctgaagtgggttttgtctgaaagatacatatcattgcccccaacgtaaactgaaatgtggacgattaaactgaggccatcaatagccttattttgaacatactgtagttggattgtaggtggcagggtttatttgcgcttttttagcgtttgatacgttttctggttatacagcgtaacggtcatgaatgcttagccataaaggaagtaatgttttgccaagcacgttgagcctctggaatttgtggggtggaaatatagaaaatatggtacataccactaaattcgacaaacttaacctgaacatgagcagcgcgcgcttttttgacgactgtcgtactgtcactcagtagcagctcatgactacccgtttggatgagcatgggaggcaggcccttaaagttcccaaaagcaggtgataaataagggtctttcaaattgtgtgaaccggcgtaagtaatgggaaccggatatttaggagcagtcttgattgtcgatgaaccaaataaaggatcgctggtaactttcgtatgatacgagctgccacttgcggttaaatcagtccaaggcgaggccaaaacgagtgctcgaggtaatgcaagcttatgatcacggaggtatagggttaatgcaagtgaaagaccggcacctgaagagtcaccagcaattataatgttttgaggctgatagccgtgctgcagcaaccaacgatagccgtcaatggcatcgttcaatgctgcagggaaccgatactttggcgcagtgcgataatctaatgaaaaaacagtcgcgtgatgatccgattgtgagtaacgcagagcggcttggttataagtgttactaaagccgcttagataaccaccaccgtgaatttgataaacgactttttttgatgcatcgggctgcttttttgaaagtaagtaagcacgtgcatgcttgagatgaacttcttgatttcgataggtcttaggtggttgccaatcctggaagtggtaattagatggtgtctccatttttttaatgataaacgactcgccatgttgtgactcatagtggcgattaatcatctgaaaagcgttattaataagattgccagacaatgaaacctttagatttggccgagtcaaagcggttgttagacaggcaatgaagaacaaaccgatggagattaaagagatttgccaaagccgtactattcgttgtgattgtttcagataaattaaaccggcaatcaggataagcaggatgatatattcaaaagtcttgaccctcaagaaaactgcgactataaaaatcaaggcaaacaaaatcgcggtcatagcatagaaacagattgttttcttttttgacatctgaacgatctccttaataaataaacttattatgtttccaagtattaatgcccttagtctagtggcctatattaagaaaaagaagtatcaaaatgggcaggaatgttactttaacttgaaagttgggccaaaaaaggtcacgctaaaaaagaaggtgatcttgatgagtaaatttcaggaaacggatcaaaccatccagcaggctttttttaaagtactggctgctgagccttttgaaacaatcacaataaataagatctgttctgaagcaaaaatcagtcgaacaactttttatcgtcattatatggataaatacgcgcttcttagcaaggttaatcatgcgttttcttcggcactagcagcttatctacaacgcagaattcatcagacaaacattgcggatacgttagtcttgatcgccaaatatttatccaccaacgccaaacctattagtgacttactacgtgtacacacacccgaaagtgatctaagtgcatcatttcagaagattttccatgcgaaattcgctcgctatatcgactatgagctttccaaaggcgctgtgacggcttttccagttgcttacttgattgaactatatttggcaatcgcgatggtattcttaagttactctttaaaaaaggggctggacgttgctgttgttcagtcactaaacgattttcaaaagcaaattttcactgaaaaaagtgaaaattaggctaacagcggtggttatctcgatttagttaaccatttattgattggtcagcctacggaattttgggagtttgtacgacattcacgttgaactttctatgataagtgttccaaaaatgcccaaaaaacaacgttaatcggcaaaaaccatacgtttattttttaaccacatactattgagcctttcaggttatattggagaaaacaaacttggaaggcggtatgtgaatcatgacagaaaaagagcgtttccggaaatttgttcgcaatggatttcgaaaagatgaagaattgggcatcccgtatcatctatattgcctagcccatgcaattttgatagcagtcccgcttggattcattgtatccgcggtgttttatgcaatggatttgcgggacttatatggtactgtgtacgcttttaacatgggcgttattgtgtttttgatgtttgaactggacatcgattggcgcattgagaagaatgaatttttgcctgagcgagtctccaagttgcaatgggtcattcgtattttggcgagtgtgctcgtttccgggatcttcttttattttcatgaaacaacagttatccagcaatttgtgaagtaagaccgagcaacacattgcctgttgcatgttatgagttgacttgttccaaaatagggtaatcggtgcccgcctgttttcagggacgaaaaaaacacctgtcgcattgatgaaacgacaggtgtttttgttgctgctggcgataaggaccatcagttttatttgcaaatgttatagctgacaaaatgcactggttcacgcgcgagaatgcattcctgagcgagtgggcttagctgcttgtttaggcgtagttggggcaggtgtttttagtgaaggatcagcatgcggtccgggaccctcaggatgattgttttgcttcatttgcctgtcagtcatactgatcacactggacataaccagcggaagtaggaagacgagcaggatgagaccaatgatgacagccagcgcaacctgaatcaaagtggtaatgccagatggaatcatcgccgcgaacgtaccgcttaagatgatcgctgccgagatgacgactgcgccaatgacactggcggctttggtgatgcgttgtgtcatcgtgccaccttccaaggcattgtcacggtagcgaaccatgaggaagatactgtaatctacccctaacgcgacaagcatgatgaaggtgaagaatggtgtgttccaggttagcatatcccggccaagcacataggttgagaatagcttagtcaggcccagtgaggtgacatacgccattagtaacgttgaaatgatgctgataggttgaattaacgaacgcgtcacgacgatcagcgcaatgccgatgccgatgatcatgatggcggcggttcgttcaaagtcaccatttgccaggtcttgaagatccgctgtttgtgaagtttgaccgccaatggcaatagtggcgtcatcaagcggtgtatgcttcagtttggccgtcagatcggttttgatcgctctaatttgttgggcggcagcatcggtacttggatcgccttttaacacaaccgttaatttggtgattttattgttgtctgacatgtaagtcgataaggctggtttaaaggttttacttttcaaagtttcattagggatgtagaacttcttccccaagtatgaatgctgcagttcggtcagatattgtttcatactgatactgccgtctgcaatcgtgccaagggcttgatcggcggaagtaaggccactttgcatggcggttacttgttgcgagatcgctttgactttcgtattcagcgtttggacgccggtgttgacttgatcagcaccactggcaatttgcgcggcaccattcgtgagggtgccgttttgtgcggcgagctgagcggatccggaactgagctggttgaccccggaaaccaaggatggtacttggctgttcaatgagttaatcccactgtttagttgttgagtgccgttcgtgagggtaccaatgccgctgtttagcgcagttgtacctgcgtttagctgtttgagcccgttacccatcgcagcagtgccgtcatttagtttttgaacatcggtagaaaattgattgatttcatttaaaatcggctgggttaactgatcggcgctggttagaccattgattttagcaatgatatctttggcaatccctgctacgccttgaagctgatcattgagagttgccataccagtggttaattcaccggatttgctgctaagttgactcatgccgttagcaagcaccgtgctattgctatttaaggtgctcatacctttagctagttgcgtcgaaccggtactcaaggtgttgacacctgagctgagtgccggcatttgatcattcaattgactaaggccgctgtttagggatgttacccctgacgtgtactggcttatcccgctgttgagactggaagcaccggaagacaacgttgtggtaccgtttgccagtgtctgaacctgttgggtacttccggcaacattggcatttttgatttgggtattggcatcgttgagaccagcctggacttgcttcaagcctttaacactttgagttaagccggcagtgatggttttcagctgatcgtttagatacaacgatttaatcttactaccgccgggctgggtcactgaagcaacggttttgacgcctttttctttttgcaggtagttggttaggtcgtcaatggtgcccaaagtggtttgggtgttcagtgcctgcttgctttggatatagatggttgtcggtgaagccatgccttttgaataatgatcctgaatcaagcggtagccgactttggattggagggtttccggtaattcatcagcgttgttaaagttcagcgtctggttgacgttcaacagaaacggaatggcgacaatgccgatgacgcccagtgtgatgagcggccgcgcgatggcaagcttggaaaggccatgccaaagtttgcttgtgctgtggccgttgaggttcttgctgggccagaatagtttttcgcccatggttgccatgaagaacatgtttaaggttagcaaaacggtcaaaagaatgagcacgccgatcgcaaccccaactgcggaccgatagaacttgaagttggcgaggccgagcacggagaacccgatcagaaccgacagcccggaatatagaatcgttcgccccccaaaacgacgggcgattcttgctgctttggtcttgggaataccttgcgacagcgctgctttgaagtcatcgtatagcagaatattgtaatctgtcccgatcccgaacaaaaccacaacgagaaagacttgggtgaagttggaaatcggaaagttaactttgtctgccaaggtcatgatgatgtttagtgatgttaagaaagaaatcgccacagttagtaatgacactaacggaacaattggcgaacggaaaacgatgattaacacaatgaaaatgaagatggccgcgataatctcggttttttgaatgcctttttcggtcacgcttgcaaaatcatcattaaggacatcgctgccggtcacgtaggttttcacatggctggttttgatttgtcgttcgagatcgcgcgtctgcggaccaacctggcctttcgctttaacgtcaaccaatgccatttgggtcgtgccatccttggcatcaagctgctttttggtttcggcattatcggatgacttggtgacgttgatgattttaacggctttggagtctttgagtttggctaaagtttgattgatcgcgcgtttttgcgttgtcgaaagcttgtcgtcgccgttactgaagacaagggcaaatgagcgcaccttttgattatggttggcttttttctcaattgtcgcggcaacttggctttcttcggttttaggaagtgataaggcgcctttatcgcgaacaatgccggatacgtcgggcatggttaaaagtgccaccaaaatcacgacaagccagaagataagtgaggggatatggcggtcgtgaagctttttcaattaaacacccttctttcacttgtgaggccattccagacttgatttttcaagtccgcggctaatggtttctgattcgagacatgaccttcaagttgctgttgggcccagacgatgtcgatcatgctgacaatgctgccgtacaaaatcgccagctgcgtccgaacgtcggctttgacaatcacgccgcgctcctggccttccagcaacatgttattgatgagcgtaatcacccggccacgcgcagcacgactctcagcgttaagtgcctcgttgaaaacattttgttgaataaaatgcaattctgtcggatattgctccatggacgcggtcgccgcatcgaataagcgactgaaagtggtctccggatcatccggttggcagtttgccgcggttgccagggagtcgtggaagaagttcataatatcggtaaaggcggtattaagaatatcttctttgcttttaaaatgccgataaatagtgcctaccgcgacttttgctgctttggcaatcgagggcagattggtttcggcgtatccacgctcagcgaagagcttcaccgcctgcgcgataatcggacttggtaatggaatggctgtcatgatattttctcctttaggaatgaacgttcattcacatatattagtttttgagaatattcatgtcaagtgcatattcaaaaaataattaatactggcgtggtgcgttattgatatcaaactaaaaactcgtttaatggcgcagaggtcagtttgcgcccatacaaaaaaagcgttgaaaaaacaacgctttattcgagactatatttcttacggccacaatttaatacagccgagaataattgaaaaaatcgcggtgccgtttttcaataggcgcccatcgattttcgggccgatgcgactgcctacgatgacaccaataccgtgtgtgacgatgataattgctagtagcggtaaggtggtcatgaattggacttggctgaggtagccgactgcggccggtaagctgatgaagaccgagtttagcaaggcgatgccaactgctgcatgcggttcgcagccgagtaaaacgagtagcggcatgaccagtaccgggccgcctgctccggaaagggcacaaatcaatccggtgacaacgcctaggatgacgagcaaaatcggttgattcaaatgattgacgccgggttttggcgggtggcgttgttggatcaaaatagcaatgccggatagcaggacgaccagataaagtaagaattgtacccagctggtcggcagtaatagattaaggcgtacgccaataattgccccgacaaagctgccgccgctgagtagataagcgacccggcgatccatgagcccttcatgttgataatgacgcgagcccaaccagccggaaataatgaaagccaggaaactgaaggccagaccttccgtagtgctatagccgagtcctgcggtgtatagaatggggagtaaaaaaccagccacgccagtcataccgacgaggccgccgattaagatgttgccaattgcgatgatgatgattgccataatgttgggtaacgccgcgcacacgcagctttaatcccttctacgtctaatgttaacacttctcggttccgcatcagccatttaccggcaaccatcgaatccgcgacatcattagcattgacactttcaagcaacgtgttattccagttgccggttggccaaaggtgggggctatcaatgtttaacccgatgatatcagcctggtaacccggtgcgattcggcccagatgaccggatagattcagagccgccgcgccaccatccaagaccatggacataattgtcggggcaggcatgacagcaggctgatgttgcaaggtgccataatgcagcgtcataacggcgcggaaaattttcatttcctgccacagactcagaccgccatgcgccgcgccatcggtacccaaaccaattgaaacacctgcctgtaataattcaggcgtggcagggatgccttttccggcgttactgaacggactgtgactgagcttgacatgatgggtttcgatgagcattttttccgtgtcgtcaagaaacagactatgtgctcctagaaaatgatcgcttaatgcgccgcgttttgcaaggtagacatatggccgctcaccgcagcgcgctaaaatacccgcgacttcctggggatactcgttcatatgcgcttcgagaaaagtctgacgatctacggcgcgctgggcggccagatcgactaatgtatcggaacaattatttaaggcgcgtaatgagtaataaacttgcaaaaggttgcggccgtggaattggtcatacaaggcgtcggtgtgggcgatggcggttttggcatccatgttaatagttgcgggtaacgtcggatcatccatcgttgagtaggcaagggcgccgcgtaaaccactttgcgcatacaccgtgccggctgcggccatgtgatagctgcctgactcaacgaaaccggtggtgtcgctggtgatcatttcaagggcggctaactgggcattaagcgtcatggtttctgccgtcatgttggcttcaaatggtagcatgactttttgccagataatgcctttcgtgtcgagtacgcggccacgtaagagttgttggccggtatgtaagtgactatcgatcaagccgggcataaacagccggtgtgagccgtcaatggtttcatctgcttggacggttatcgtcccatggtcactgacctgcgcgattttatcgtcgcggattaaaatatcttgatgcggcttgatctcaccaggcgcggtcatggttaaggtatcctgaattaatgtgctcgtcacttaaatcacccctgtcagtttcaacgtgagcgtatcccacagaagcgaaccgacaaatgttccggtcatcacggcaaccccgacaatgatgtacttccagccttgatggacaaatgtgcccagcttatccgaaattgcaatgccggcaaacgagccaacaacggtaaacggcgcggcaaacgcaatgactttggtagaactaatcacaaccgcagcaatcggtgaaaatggtgaggcaacgagtaggcctaaaatggaacagtacgcaataatcggcaacttgaatggcacaattttagctaagaccacagctaccatggtaacggcaattaaaatgatcacgccggggaggcttttagcgatactgacgccggaaccgatccagttggctagcagcgtcccgaccccacaaacgctgaggagaaataaccattcacgtaaacgcattacttaatccgtcctttcaaagcggttgccgttttagcgcggcgactggcgaacattttatcgaaaagattgtagagcttgtcggttagcgggatggctagaaacagggtgatataaatcccggtgatgccggcgatggtgttggcagctgaagccatggcggtgatggtgttggcatcatgcgggaatagttgcgcaaggctggcactggcagaggccatgaaaatgccggctccaacgcctgtcgacatccccaacgccttgggatcaaaccaacctgtcagtcccaaagcagttgccatcatgccgaaataaatcgtgccaagaataccgccaacgatgtaaatcgccatactgccgcttgcttcatcagaatccgaaccataagccgaattgattaaggcaaggtgatattcgcgattcagtgaacttgttgcgccaattgcctcacggtgcagccccagcaacattgccagtggtaggccgaagaagatcccgagcagattaccgaagccgtgcaccagcaatgccggaccagcatgtaagatcatgtccatatttgcgccggcagtaattcctaggttcacgacaaacgggcaaataccaacgataaccaatttggaagcagctttaacatggcgattgtcaaaccactgcatcacttgcggcccactgagcataccaagaataatggcataaaaaaccgggaataaaatgatcatgccgggaccgaccttgagtttcaccgttccgatatattcggcgatgacggtgaacaatgctgcgacaagataactcttccattcgactttgatccgtgcacgtaaactgggataagtcatgttttgcctcctcttttagcgaatggaaccagtttagcgcagttattcgggtaaataaaggacaattacattaaaaaacgttttaatgttcgcgtttatccgtcagcacctgatggacaaccttttaaaaatgaataagtgacgagcatgacaaatcatataaaaagccaaaagtcagttaccttgaaaaaccgaatcaagatccaataacgaaagatcaagtgctttctgtatttggttttgattcggcaaagtttcctgacgcttggcgatggtgctaagtagctactgtgatcagttgttgatcacgcaattcaataacgttatttgctgtatttagtcgtttttggccgacttgttttgaccttttgttccagattctgctcaggtaggctggctggctcttcgtgaaacagacggggcaggtggcgtggcgcaacagtcgatactgacgtgacaacctgttgaacatgctggtttggctcggtggtgggattgacggttgttgcggccgatccgctgctagtcaacaaccccgcggcaaccgctaaaaatgtaaagaccatatgcaaaactcccttcgactggctgacattctttaataacagcgattaacagtcagtttagtaaggagatgtgattgatttgccgcatttgtgaggtcttttcacaacgaaaatgaaacgaaaacatggtgattcgttaacagaagcgtaaagcatggcgaatatggaccaaaagttgaagaagtatggatgaatcacgcgccgggcagtaaaaaattttgaacatgaaaaaagacgactcgggtaagtcgcctttttactgtttgctcgttttcaattatgaagcagattttccttttggttccaagcgccgttccaaaaagcctaacgccaggtcggagataatcgccattaaagcggttggcaatgccccggcgagaatgatcgcaccgccattggttgcattggtaccgcggacgatgatatcgcccagaccgccggcacccacgaaggcaccgattgccgtaatcccaatggcaacgaccagcgcgttacgaatcccggccatgatgactgacatgctcaacggaatttcaaccatgtacagtgattgccagcgggtcatgcccattcctttggcggcatccatcaggttcttgtcgacattctgcattccggtgtaagtgttcttgatgatcggcaacaaggagtagagaaagaccgttacgatgacggtgttcacgccaagaccaagcccgagcatgatgatggacaacattgccaaactaggaatcgtttgaattacgttggcaatgccgattaccgtgttgctcaaggtgcggtggcgagcaattgccaagccaaccggaatcccgatcacggccgcaatcagcacaccataaattgaaatcagaaaatggcgagcaaactgactgagcacgtacgaaccgttattggcaaggtaataccagaattgctgccaagtatccatgttagccattagtcgtcacttcctttgaaataattgtgtttagccagaaacttctgagcgaccacattcggttcaagtaattgatcgtcgacttgatagttcaactcctgcatggttttcagattgatcttgccgtctaaacgatgtaacagcggttttaattttggatatttcttcaaaagactgttgttaaccactaatgaacactgataaggcgggaagaactttttatcatcctttagaatcttcaaattgtaactgcgaatgcgaccgtccgtagaatacccgagaaccgtctgcatccggttggcttcaaccgcgtcgtaaaccaaaccgatttgcattggataaacgcgtttgaaatcaaatccgtatgctttggtgaagtcactgtagccgtcgcctttgcggttcatccagctagagtcaaccccggcattataacgtgatgcgactttctttaagtcggaaatgttgttgaggttatccttcttggcttcttcttgggtaaccatgaaagcataggtgtcagagaagccataagacggataccatgtttggtcatagcgttttttgaattcacgcttgacgatggtcatcgctttggaaggacttttgacagggttcatgcctaatgtgccggtgatatcggtgccggtgtatcgagtcgcactgatatcagcatcattacgaatcatcgcttggtgaaccaccgtcccggaaccaaggttgttcaccaaagtcgtcttgtaaccgagttcgtggttgattaattcggcaatgatattcgccataatctgtgactcggtacttgtttgggaggcgattcggacggtaccgtcattaccggaaccgccaaggccagggaagccgcaaccgcctaatagcagcaccggaatcagcaatagggtcaggagtagttttctgaatgtcttcatcttgccacctcctaagcgcgctcgctgacaggtgtcaggtggtattccaaccgccctaacaaccaatcaacaatcagtgccaaaatggttacaggaatggtcccgccgatgatgagatccggctggaagagattcagaccattaaagatcaagtccccaagtccgccagcaccgatatacgatgccagggttgcccatgcgatgacataaatagcagacaagcgaattcctgccataatgactggcatggctagcggcacttcgacttggcgaatggattgcatggcggtcatgcccattcccttagcagcgtccatcaacacgggatcaacatcttccatgccgatgtaagtgttacgcaaaattggcagcaacgagtagatgaacaatgcaacgatggcaggtactttcccaatcccgaataaaggaatcattaatgccagcaaagccaacgaaggcaccgtctgtaacatgctggcaaggccgatcacgactttagccgtcttaggaaaacgggtcagtaaaatgccaagcggaacggcaacaatgaccccgagtccaagtgcaattgccgagatgtaaagctgttcccaagttttggtaatcagttcactgccatgtgcgtttagaaatgcaaacatggtcacacctccttaggtgcgtctcgggtatcttcagttgccgaagtggtggtcgtcgacgatgcggctgactgatcgttattcttggccgcagcactgtcttgatcatcttcattgtcgccccaaatggtgtcataaacgacatcaacaagtgaggcacgggtgacaatgccgaccagtttctgatcattgtcgaccacaggcacatacttaaatccgcgcttaagaatgcggtcagccgtgtcgcgcagtagggcatcttttttcacatagaaaatgctggacttagtgatatcactcacactggtggcgctttggtaacgggtttccaatgattccagatcgatgaagcctttgaggtgatcctcgtcatcggtgaccagcagcgtatcaacgcggcgtttgcgcatgagggaaatcgcttcagccaaagacttgccaggtgtgatggcagccggattcttcaacatgatctgttcaacagtggtgacgtccgcccgcgcttgaaccaggcgatcctgaccgactaagttttcaacaaacttgttggcgggatgggtcagtagttcggttggggtggcgttttggataatgtgaccgtgatccatgacaacaattttggtggcgagtttgagcgcttcgtccatatcgtgggtcacgaaaacaacggtcttaccgagcttttcctgcagatttttaattaattcctgcagtgcttcacgggtaatcgggtccaaggcgccataaggttcgtccattaagatcagatcctgattggcagcaagcgcgcggataaccccgatccgttgttgttgcccaccggaaagctctgatgggtaacgatccagataatcttcgggtaattcgacgagatcaaccagttctttggccttttcccggcgcttttcttcaggccactttaataatttaggaacgatcgtgatgttttcataaatggtcatgtgtggcatgaggccgatattttgaatgacataaccgatttgacgccgcaattttacggcatcgattttgtgaatgtctttaccgttaaacaggatttgaccgccgctgggttccaacatccggttgatcatccgcatggtcgttgtcttcccggaaccggatgtcccgataagacatacaaattcacccttattgatttcaaggttaatatgttcgaccgcgacattcccgcctcgatagactttttcaacgtccttgaacaggaccattggttgttcttctggcatctgacgcgtcctcctttgtttggttgcttctatgataacacatgaagttaatcgttttttaataaagccaaaatgccaaaaatgcctgctgcctgcataacttttcagttacagcttataaaatgattaaatgaaagtcgagaaagttcctctgattagcgaactccgtgggtcaacaacaagctgacgagtaccactgctccgtagcccagtgccaatcgggtttggccgattgcaacagcagccatcgctgtgccgccaaaaaggacgatttctgcgatgagccgttgccactccaccagctgaaatggcgatctgggtgccatccagcgcccccaggcgagcagcaccgcaatcgggagcgcaacgccgccaattaaccgaccaaccaacgaaggaaaatgccaacccgcccaaatgagcaagctgacagtcgcaatttcgaccaggaaccgtaaaccgtcaattaatgatttaatcatccagctcacccacttgattgatcaagtcgttgacctgttgcggattattggttggtttttcgatttcttggctgatgcacgccagtacggtcagaagaccttggtagaaccgcgcttgcgcagcggcatcccttcgtttcgtctggataaaggcaagcgcctcgccgcgacaatcggccgtgattggccgctgctgcaaggcaagtaccttttggcactcgactaggcttagccctgcccgcttcaaattgatgatcacttttgctgtcgccgcgtccgtatgattgtagcagcggtaattgcctggtgtccgggcggggattaataattgtttcttctcgtacaggcgcagggtatcctttgataacccagtctcttccgcaaattcttgaatgttcatgcagccatctcctttgggtggtgtaagcatagcattagaccggggtcgaaggtcaaccgggaagacacaccgcgtattggttaaaaattgaacgcaatcaaggtgccatggatgctcccttcttacgtgacgagtaacaaaaaaaccgagatcactaaactgtgatctcggcttttatggcggcctgattcatcgtgatttaatcggttgataccttttccaaaggtacttgatcaatatgtaaatcgaagcacaggtaaccatgacgctcaaacttttgaggatggctacgaatagcatattgtttggccaaaagttctcgagaaatttgaaggcaatacgattaaaaataacgaggaaaagtgctgcccaaacttctttgtcttttttcatgaagaatcctccgaaatcagctagatgatttggtaacattcgaaacgcaataaatagtgagttatataaaaataagataaatacttgagtatgaattctattatagaatagtcgactgctgaaagacaagcgttgataagtcgacggctgcctattcttgacatgatactataaaaaaattactttatttgcgtttcctttgacaacaggacacaggttagacattctttggcattaatacaagatctacaccacatgggatctttatcagttgtggctcactgcatgatcaatgtcactgctttgatcaggcaaaactaacattactacttagttcgccaaaattgatcccggtcaaggtaaaaccagatgcttctcggtacactggtctcgaatggagggatcagcgatgcgttttattcaaacacataaacaggaagcgatggtgatcggcggtgttctgactgcggcgggattgattttcagtcaggcatggttgctggtgttggcgagtctggttgccggcctgccgattgcggtgaatgcctgggaagcgctgcgttataagcaaattagtattgagctattggtgacaattgctttagtgggcgcggtgatgattggcgagccgattgaaagtgcggttgttagttttctatttttgttcggtgactggttggaacagcgtagtttagccaagacgcgctcggcgatccaaggcttggctgccgcagcaccgaaaacggcccggctgctggatgggacgaccattccggtggggaagttagcggttggcgatcaagtgcgggtgttggctggcgaaacggtaccggctgacgggcaggtgattagcggccaggcaaacattgtggaagccgcgatcaccggcgaaccggatgccaaacgcaagcaggttggcgccacagtatactccggtacgcaggtgagcgatggcacggttgacattgaagttgaaaaaaccggctacaacacggtttatcagcagattatcgatttaattgaagatgcgcaggacgcccaatcgcctgtagcaaccttcatccagaaatttgcccgttggtacacgccgctggtattagtcatcgctttgctggtgggattgattagccaaaatgtccggctggcgattacgattttggtactgggttgccccggcgcactggtcatcggcgccccggttagcaatgtggtcggtctaggatttggtgccaaacatggcattttaatcaaaggcggcgatgtggcgaccaagttggatcaaatcgacacggtgatgtttgataaaaccggcacgctgacacaaggcaagatccgtgtgacaacggctaagtattggaccgctgatcagcaacgggttgcagctatggtagcagcggttgaaaaagcaacggcgcatccactgggacaagcacttgttgctgatcttcagacgaaggccttgcaaaagccgaccgatgtcaaagtcactcgcggggttggggtgaacgcccgaatcgccggacacgcgatcagtgtcggcaatcaaaagattttgcaccagccgctaactgctgaccagcaggctgatattcagcaaatcgtggccagtggtgcaaccttggtcttggtaaccattgacgacaaactcgtggcagcttatggcttgcgcgatcagttgcggacggaaacgccaaccatgctgagcaccttaaaagcaagtggcaagaagacaatggtgctttcaggcgactcgcaggcagcggttgaacacatgatgtcggcactaccggtgagtcagacgcgcggtggtttactgccggcagataaggtgaaagcgatcaaagcagcacaagcccgcggtgaaaaagttatgtttgtcggcgatggcatcaatgacggcccggccttggcacaagcagatgtcggcgttgcaatgggttccggcatggatgtcgcaattgacacggcagacgttattttgaccaacagccgtctcacaaatctcggcgtgcttttcgacttagccaagcggatgaatcgcaacatcaagcagaaccttgtcattgcaattggcacggtggcgttgttgttaagtggcctattgatcggattggtcgacatggctagcgggatgttattccatgaaatttccatcctgctggtcattgcaaacgccttgcgattacgacacacaccaagaaaatggcaaaacttgacggccatcaaggtacgtcatccgcaaacggttaataatgagaataaataaaaacgaaaggatctttaacatgacaaaattagtttatcaattagatggtttaacctgcccgagttgcctacagaaaatcgaaggggcactaagccaacaagccggcgtcaaaaccgtcaaagccttatttaacagcagcaaggtcaaagcccagattgatccagccgtgaccaatgccgatgcgttgaaaaaaaccatcacggacttgggctacaccgttgtgaacgttcgtagtcaagaagcatagagcgtgagcaggagcgcttagcaatcggagtgtaagcggccttaagcctaaatggccggtctttggccatttaggcttaaggtccttacgcgcagattgctgcgactgcgaacgcgttttagaacgagcgtaagcagaaacacctaacaaacgtagcacaagaggttttaagcgtgggccgggctttaatcatgacacccaagacctttacacccaggcttctagcgcggcaaacgcattttcaaggaggaaatcatgagcataacaccaggcatgcacactattgccgaagaaacagtaaaagcccaccaagcagcggcagctaaacaagccgaccatgatcatcatgtaccgacagctggggcgatgagcggacatgtactagcaaatttagcagtcttgcaacgtaaactggcccaattttcccaaacgttgagtggaccaagtagtgacggggatcgcgaattgttaacgcaattggcaacacaagcgcagcagcatctgacggtgttagtagcagacttagcggcgcaaggagaagattttcccacgacaaccgcggagtttagcgagtacacgatgttgcaggaagatcccgcgtttcgtttttggaccaatgatatgaaactggatgctgtggttaatgatctggatacttgccagctgttcgtcagtcgggcgattccgctagccaataaagagaacaaggcagtgttggcagcggatatgttacaattgcagcgctggcatgagcaaagtatcctgcacttgcaaacgcgtctcggtcgtgaggtgacggcggggcggaccttgcttgaagaggacgatgactgagcaacattaaacgatcgattgacgagagagcctgtctgtaagggggataaaaatggcgcatagttgtacggcggtcgtaccgttatttaaaaatctaactgatgaagcccgcactgcgattgatgcgttgacccacgagcatcaggtgcaaaaaggaacggttctgatcagtcctaacactgctgctcatttgttagtggtcgcacagggaaaactcaaaacttatcaattggcgacaaatggtaaagagcaattactgcgcgttgacggccccggtgattatgaaggggaagccggcttgctgaatatcgctaatccgaatgtctataccgaagcgctaacgaccgccaccgtttgcaccattagcgctgccgattttcaacagttactcatgcaacaaccacaaatcagcttgcaattactcacagaaaacgcccgtaaaatgcaggcattggaaaagcaagcgggctatctcggcaacgattccatcaatatacgcttaactcactacctactggatctgcgcactgccgctggaaaagacacagtgacggtaccgatggcatggacgcagctagccgattatctcggcacaaccccagaaacggtttctcgcacgttaaaacggttagctgatgaaaaattgattcagcgaactgggaagcaagtaacgattttgaatgctgaggatatggaagattttgtttggtagggttgtcgttctaaatataaaaataattaaaaagccagtgagcaattgctatgtcgcttaaagttgaaacaaaacttttgggacatgtggtaaatcactggcctttttgtatagtcatcgtttaatctcgcagatagacaagatgatctttaaggctgttgatgatgattcgggttaacttttcaggatcgatgaggcggtctggcgttaaatagtaaagaagaatattccaaacgccgccaataatcagcaagtcaatgaccgtttcatcctttgttggtgaatgccaaggcatcgcttgttggggaagcatctggagtagctgctgccgttgagcttcaaaaacaaaacccagcaagttattcttttgcaatactaaaagttcatgccgctgttcttgccaaaatgaaaaatagcagcacagtaaatcgtgaaagtttttgatcttttggtcagcaactttggccaaatacgcttgaacggtactttgcgtgtaatactgaataatcgcgaacttgctgggaaaatgttgatagaaagtttttcgagaaacatttgcttctgccgcgatctctgaaatcgtcaattcgttaaacggatacgaggctaacttattaaataaagctgtaacgattgcctgttttgatcttaaagcagttttattcataattactgacttccttcaaaagaaaagtaacataaacgtcaatatgtcaccattatctccaaaatccttttacatcgcatgaacatattctacgctataactgtaacaaatgttacgttttgaaaggagtttggaaaatgttacttgattattggatgttaccaattttgttcatcttacatgattttgaagaaatgattatgatgccaatttggaagcggcagcacaatcagcggctccggaaaatgaaaaagtccttctttggtgccgtgacgaatggacaagccttttcagtgggggttttagaagagttaatcattttaatcggggtatcgttagtcagttcggtactgcacagtgatcgtttatatctggccttcatggtgacttatacactgcattttctcatgcattatcgaatgtgctttgaatttcaaggttacgtgcctggggttatttctgtcactttggaactaccagttatgatttggttgataacgatttattggcaacgaagtcagagtacgttcggcgaatttttgggctatgtgactgtagcttttctcattcagtttgttaatttacgtgttatgcacacacttatgccaaaaattcaggcaaagatggcagcctatacgaggacgtcattgctttagtaagttttccaaggcgaataacaacaaaggacacaaccggttttggtctgcggatgtgtcctttgttgttatcagtcaggattagcaatgtgttttttcatgccgaaataataggtaacaacggctatcattgaggccaaagtgaaagcagaaagatatatctggctacttggcaggaaataccaagccgaaattgctaagagtatgcctgtgatcaaatagagatacaggaagatgcgggttcctttcaaattggcaggcttcgttacgagaaaatagaggaaaaaagccgaagttgcaataccgaaaattatagaagcgatgtgtaataacatgtttgagcctgcctttcgatcgggtgttgctgtaatctcacagaacaatcaaatattgaaaataaccgttaaacggtactagttcgccgataaaaccggatgcgtgcgtcgtttttgccagaagagaaggataatccccagtaagactaccagcaatatatggacaacatttgacgccacactagcctcaagtccaaaaacgccgccagtcagtgactgcgatgtcgttgtcgggagggactcgaggacgaacttttcaccggacagcccggaaacggttgtgccaaagatgggaccttctgcaaaattccacatggcgtgaaaagcaccgcacagccagatgttgcctgtcagtaagcgaaattgtgacattgcaatggcaaagaaaaacaagccagtggcagcggaaaaattatagccgggattggcaagatgcaaaagtgtgaaaaagatggcgttcaacaaaaccgccagcccgacacgattttgtttgagccagtagcccattatatatccccgacaaagcaattcctcgaacatcgattgaatcgcatagccgaaaaagaaaagtgccagccacagcaagtttgaccattggaaagtcgccagcacatggtaaccgccaagcaatgcgatgatgccccagatgaggctgaacatgagcaggccaaaaagtaagcctaaagcatagtctctaacggcatttttacgggaaaaaggcagcaatgtacgatcactgcgataatagatggccatgccgataatgccgatagcttcagcgtataaaaagagcaggttcaaagacatcgggatgttggtttcatctatgtcgatgtcgaacagacccatcaaaaaaggaatcagctgtgatgacaatgaccaagcaagtgcaatgccataaacgattaggataggtcctaatagctttgaaaatttatgtagttgtttaattggattcacctctgaatagaatttgaatagagaagatagcttaacaacaaaagaatatttttagggtagccttaatttttagcgtagtcaagcgatccaaaccgagttaccggtgaacgcgttataggcgcaggcggttcatctcacttgaaataagtatcactaacattcggaatactggtactagtacccaaatgtgcgaaaacgcttttattgtccttgctattccgttagtcttcatattgaaaataaatagataaggggtccagcaatatggagaagaagattgttgccgtgacggcttgtgcagcggggattgcgcatacgtatatggctgcggaatcactggagcaagcggcgaagaaaatgggctatgagatcaaagtcgaaaccaatggggcaatcggtgctgagaacgtgttgacgaagcaagatattgagcaggcagacatggtcattgtcgcctcggatattaaaattgatccgattcgatttaccggtaagcggcttttcgttacccaatcaaaccaagcgattgaagattcggaggcattgatcaatcaggcgtttgaagaagccaaaatttttggaaaaaaaggtgcgaaggttggcaagattcaggtaggtaacgataaagataaggtcaactttttcacgcatattatgagcggcatttcatacatggtgcccatggtgattgcagccgggttgcttttgacgattgctaatctgtacgcctttcaaagagacgatttaggccgaattgttaagtggggctttgacaataaaacgcaaatgggattcttgatggccaagttgttctatgtggggcaaatcggctttaagttgatgattccgttgtttgccgggtttgtcgcgaattctattgctgacaaaccagcgattgccccggcgatgattggcgcttatttggtcaatgatcccgagtttctgaatacgaaggcgggcggcggttttattggcgccatcattgttgcctttattgtaggttacatggtgaagggcttgaaaaaagtgaaatggccaaaactgctggtgccgattgtgccaatcatgatcattccgtttatcgccaccgcggtcattatgttgattgttctttatgtcatcggaaacccgatcgcggttggcatggatgcgatgtataaaggtttgacggatctcaataacaactattccggagcgccgattttgattggcgctatctgcggggcaatgatcgggtttgatttaggtggaccgatcaataaaacggctttggtctttggaaccgcgattttcacggatacgttgaccaagtatgggattaacggggccaattttgttcctggaaccgcgacccaagcagcaatttccgttgcgccactgggagtttagctggccaccatcttattcaaaaagaaattcaccaaggatgaaaaaatcgccgccagtgctgcttttgggatgggaattgtcggcgtcactgaaggcgcgatcccgtttgttgccgctgatccagtcagaatgatcttctctaacgtggttggttcagcggttgccggtggtctagtagctgcgacagggtgtaaattttacggcggtattggctcgccactgggaacttttattggctatattgaacagccgctaccgtttattacttggatattatgtgtctgtgccggaatcctgaccgccgcattgttaatcggcttcacccgcaaacaaacagtggaaggactcgctgttgaacccgaaaagtaacgctaaccgctgaaaccgaaaaatgaataggtaggtagaaaagtgaataaagaagtttttaatcgcagccatattttatttgatgaaacggcaacaacccaggaagaagctttcaaaagcctcgccaaatttgcttataacgcaggctttgtcgctgatgaaacagcctattttgaggggttaaaagctcgtgaaaaggaagcaaccaccggctttaaagatcatatcgccattcctcattgcaaaagcagcgtcaataagaaaccggggttattcttaatcaaatttaagcaggcaattccgtggcaagcattagatcaaaagccagtaaaggtggcttttggcttgaccattccggaacaaggggccaccgaacatttgaagttgctaagcctgattgccagaaagctgattgacccagactttagagaaggggtcctgacgcaagatgatccagaaaagctgacagcaatcattgatcaaatcgaatttaggggttaatgcagaagtgaaaagaaaagttcatgtcatccatcacacccactgggactttgaatggtatttcactgccaacgagtcactggtgcagttggcttatcatttggatgaggtcatgcaagccttagagcaacagcaaatcagttactatttgctggatgggcagatgagtattcttgatgattatttaaccagttttccagaacaaaaagagcggctaatgaagttagtcaaaagcggcaaactcgctattggtccttggtatacgcaaaccgatgaattaatcgttcgcggtgaatcaattgtcagaaatctgaatctaggcatgacgttagcaaaatcattaggtggctacatgaatgttggctatttaccggattcttttgggcaaagtaaagacatgcccaaaatctacaatggggttggcattcagcaggcagtcttttggcgcggggtgcctgacgatgtgacaacgcagcgtgaattttactggcaggcagaggatggttcccaagtcttaaccgcgaatatcaaagatggctattttgtgggcgttggtctgatttattctgatgatgcgcctgcccttgtcaaaacgattgcggccggtgctacgggtgcagatttactgttaccggtcggcggcgatcaacggtatattgattttaatttgcgcgatcgcatgaacctgtatcgccaagtgcttcctgatacagagctagaagaaagcaattacccggcgttttttgaggcaattaaagaaaacgagctaccaacaatcaccggcgaatttatttctagtgcagtctccaagatccatcgttccatttactcttctcgttacgatcataaatacttaaatgataaagtggaacggcgcatgatttatcaagtggagccgctgatggtgatggcagaaaaatgcggaatcccgtataagcaaggcttgctagatcgaatctggaagctgctgaataaaaaccacgcacatgactctgccggcgggtgtaatagcgacaaaacgaatcggatcatcactgcgcgctatgttgaagcagatcagctttcttactcattagtggattacctcaccagaaaaatttccgaatcgcgagttcaggtatccgaaggcgaattggtgatttttaataccttgccgtggacgactaaaaaggtcataaaatgtgaggtatcgactcactttgccgcgatcgcacttgaaaaagacggcgtgacgattccggtcgaatgtttacaaacacgcaaagaatcgaatcgttccattcgccgaaaagaagtggcggatgcaccctccaacgcttattacgttcatgaattattgattgaagcagaagtgccgccgcttagttttgtagcgtatcaggtggttgaaaaaaatcatacattcaccgataaaacgctagccgaaaacgcgaccgcttcgattgaaaatgatgcgtatcaggtgacatttaaagcaggcgaactatccttaatcgatcgcaaacgcaaaaccgtctatcagaactttttggcgtttgaagatagcggggatgaaggcgatacctatgattattcgccaccttatgtggatgatcggtatcgactcaatttgaatggtgctacttgtcacatgatccgcaaccaattaatggaaaaactcattattaccggtgagtggcaagttgccaaagacctaaaggaacgccaaactaaaaagcgaacccaggcaagcccttatgaattgacgattgaactattaaaaggcagtcgccagcttcaatttcatttggagctcgacaatcatgcgtgtgatcaccggatgcgggtgttgattgagacgccgaatcagaatgctttttcctattcggatacgccgtttggtacggtgaagcgagcggttgaggatcctcatattgacgattggcaacaactgggctggcgggaagaaccaacggcaattttcccgatgctgacgtatgtcaacagtcatgatgcgacaaccagctggacggtttttagcaaggggatcaaagagtatcaattcatcggcgaaaagtttcaaacgatggccttgacgttgtttcgctcggttggttatctcggccggccggatctgctaagacggccaggggtggcttcaggcaatgagtttaaagccattccgacaccagatagccaattgcaaaagaaaatgcgcttcaaatttgcactgcagttagatcacgattttcagccagcaagcttggcaaaagattatctcgactatgcgatcagcagcccgtattaccagatccaagacctgaatcgctttaccacaacgcttaagtattttgtctcgaatcctttaggccatcaagtgccaacaccaaaaggaatgacgcttgacagtgagacgctggttttcagctcattacgcaaaagtaacgacgaaccgggctttgatattcgggtttataatccggatcttaaccgggaagtggacggcggcactatcaaaggcttgcgtgatgtgcggtatacgtttgtagatctaaggggtcatgctgtcactgaaacctatgaagatgatacgattctcctaggcacctttaaaccgggtgaaattaaaacggtccatatcgttgaatgaggagaaaacgaatgccagaagatatttttattttaatcgagtcgtgtcggttgaacttcactgctgtggaacaggtgatcgccgactaccatttgagtaaacaaccggcgatgaccattgataaattatctgcgcacttagcggtgtcaaaagcttctattacgcggttttgtaagaagatcggtttgagtaattacaaagagttggtctttctttacaagctgtctttaaaccaggaaacgactgatttatccgtatcctcaaagatcacggcagcctatcattcgcttgcaacccgcagtgacagtcattattcacaagcagtcattgatgctttttgtgaacggttgcatcaacatagaatcattcatttttttggtaaaggcttcaattcttacgctggcgccgatttccagttcaagttttcccgagtcggcaagtatgtccgcgtaatcgctgatgaaaattcgattttgatgtctgccaattttgcgaaccaagatgagttaatcatggtggcgagtttgcgtggggatgacgaagagctgctgaaagcgatgaaaattgccaagcagcggcaagtaccgattctactgattacgtctaatcgttattcgcaacttgttgcccatgcggacgtgacgcttattgctgccagtttgaccaaagaagaggctttaggcaatatctcaccacaaattccgattttgattcagttggatatggtttatgagcgctatatccatttatatgccgatgccgtttctcaatggttggcgtcggaacaaattttacacaagtaacggaggaagcatgaagaaatttcccgagaactttttgtggggcgctgcaatgtcggcaccgcaaacagaaggccagagtttaaatttcggaaaatcagccaccatctgggattactggtttcaaaccgcaccggagaagtttcaccagcaacaaggaccagcgatcacatctgatgtttatggccagtatttaaaggattgtcaacgcatgcaggaaatcgggttgaattcaatcaggacatcgatttcctgggcccgtctcttgccggatggaaaaacggtcaacccacaagcagtcgcgttttaccggcagtattttaccgccatgcgtgatcatggggtcgaaccgatcatcaacctgtttcattttgacatgccgatgtggttgatggcgcgtggtggctgggaaagtcgggaagccattgccgcctttgccttttacgcccagacatcatttgagttgttcggtgatctggttaaaaaatggacaacctttaacgagccgcttgtccatgtggaatgcggctacctgtatcagtatcactacccagcaatagtcgattttaagcgggctgtccaggtggcttatcataacttgcttgcacataaagcagcagtcgcgaagtttagaaacacgctgccgtctggtgagatcggaatcattttgaatatttcaccgacatatcccaaaagtgaagcaactgcggacatgttggcagctcggcgctcggatctcctgaacacgcgtagtttcctggatcccgcagttttggggaccattccggatgatctagttgcgttgttaagtgaaaatgaattgctaccagtgacgaaacccgaagatcaggcactgattaaagaccatatcgtggatttcatcggcttaaattattaccaaccgcgccgagttcaggcaccaacagctcccaaaacgcctgcgcaaatgccggccgacttttatcagccgtatgattggcccgacaaaaagatcaatcctcatcgcggctgggaaatctatcccaaagcgctttacgatgttgccatgatgatgaaaaacgactatcacaacatgccatggtacgtgagcgaaaatggtatgggggtcgcaaacgaagaagcttttatggcggataacggcgagattcaagacgactatcgcatcgcatttatgaaagaacacttaaactatttgcaccaaggtatccgcgaaggcagcaactgctttgggtatcatgcttggacgtttgtggattgctggtcgtggttaaacggctataagaatcgctatggattttatcggctggatttagcgacaggccaacgatcaatgaagaaaagcggccgctggatgaagcaggtcagtgaaaacaatggattttagaggtgaccaatgagtctaggggtatttgatataggcggaaccacggttaagcacggcatttgggagcatcagcagttaagcccagtcaacgcttttccaacacctgtcacatttgatgaattactaagaaatatggccgaaattatccgcgatgccaagcgcccgctaacaggcattgccatcagcgcaccaggagcagttgaccaagaaaagcggaaaatactaggcatcagcgccgtgccttacattcatcaacggccgatttttgatgaattcgaacaacagctcggcttgccggtgacaatcgagaatgatgccaactgtgcagggatagccgaagtagaactaggcgtcggcagagaagcacaaaatattgcctttgttgttctgggcacaggagtaggcggcgcactttttgttaagcggcaactgtacaagggaagccatctgtatggtggggaaatcggcctgctgaaaagtcagagtcagcaaatctttagtcaaaccggaactttggtcaaagtcgcgcaagcttattctgaacaagttaatcgttcggttgatgggaaaatgctttttgagttaagcgaaaaaggggacacacttgcaaaatcggcgttggatgaaatgtatcagaccatagcaaaaaacctctataatcttcaagttctattcgatccggaaatgattgttttaggcggcggcatctctcggcagccaacattagcagctgagctttcagggcagttatttgagcaactaaaaaaagaaggcattgaagaaatcatgccggtcgtcaaatgctgccattttcataatgatgccaatctaattggggcggcgttgaacttccagaagattttccctgatcaggatcggagttaagtaagtttaaatccgagtgggtcaagttttatggcaactcttagccatcattattaagtgaagcgtgttgaatgattacctggaaatcccatagactgagattaagttcaaagaggagattgaatgactcttacagtcctcctaggtctttctcctttactttgcattcgagtcgttatattatcagaatgcttttatttaccagttaatgggtccatctcaatttatggcgaggaggatggaacatgacactgcttagaaaagttatttgggtattcgtgtttgttatttatggggtagtgcttttttgggcttcgttttacagcaacagtgcttattttttaccggtgatcgccatccctgctattttttcgggaatattttggctaatcgaaaatgttaagaaaaacaagaagtgaggaatgttcgtcttactgtgccactttggtttagcaagatgctttattgtcgattgatattacgttccgccctcttttgttgctttaactgaatgcttaagaagcggttgcttagaacgtaaatcaataaaaatgaaaaagatcgcagtactcggtttgagagtattgcgatctttttggccagtggctactttacggatcaagtctacttaaatcagacaacatttaagcattcctactaacgacagactcggtttgcttttgcgtatcaaccgctgcccgaatcgcctttgtaaactgctcaatcgcagcgggggcgttttgcgcttccttggcgacaatgtccacgatggcgctgccgataatgacgccatccgcaatcgacgccatggtttgggcttgttgcggggtatggataccgaatccgattgctgttggcacatcagtatagcgtttgatttccgtaaccaacgtttttagaccagtgaaaaattcgtcccgttcaccggtgatgcccacagaggaaaccacgtagatgaaaccagaagcacttttggcaattttttcgatccggtggccagaagtcggcgtgattaacgggataatatcaatgccatacttttctgcaaacggcacaatttcagcgcgactttcgtatggcaaatcggggatcaccagaccgctaacttttagctcggcgcaacgcttcaaaaaggcatcgtagccgtacttgaagacgatgtttaagtaagtcagaaacacgatcggcaccgcggtttccttccgcgctgccgcaacgatttcaaaaacggttttggtgcgcacgttggcagcaaatgcgcgcaggtccgcagcctgaatcactggtccatccgcaaccgggtcagaaaagggaatgcccaattcgacaatatccgcgccgccatgtgcaagggcaacaatgtttttgacagtggtatcgaagtccggatcgtccgcaacgacaaatgggatgaaagctttatgatttttgaagatggcagctaaattactcatcaacgtcaactcctttgtatttggcaatgctggcaacatctttatcgccgcggccggataaggtgcagatgatgatttggtccttggccatggttggggcaattttttcaacgtaagcaatggcgtggcagctttcgatcgccgcgacaatgccttcttgtctagcgatgtattcaaatgcctgaaccgcttcgtcatcggtgattccaacatattgggcgcggcctgcttcggcgagggcggcgtgttccgggccaacgccggggtagtcaagaccagcagagatggagtaaaccggatcgatttgaccgtcttcgttttgcatgaataaggatttcatgccgtggaaaataccgacactgccgcgttcgatcgtagcagcggttcgcgccgtatcaacgcctttaccagcggcttcaacgccgaccagttgtacagaaggctcatcaatgtatgcggcaaaactgccaatggcgttactgccgccaccgacacaggctacgatcatgtccggcagctgtccttctttagcctgcagttgttgcttggattcaatggaaatgacgctttgaaaatgtttgaccatctccggaaatggtgctggacccacggcagaaccgagcacataaaaggtgtcatcgctgcgactggcccattcctgaagggcagcgttgaccgcgtctttaagcaccatcgagccgctggtgacagaatggactttggcgccgagcaatgtcatgcgataaacatttaacttttggcggtcagtatcttcttttcccatgaaaatttcacattccatgcccatcaaagcggcgatcgtggcggtggcaacaccgtgttggccagcgccggtttcggcaattaaccgggttttgcctagatgcttggcgagtaaggcttgtccgataacattgttgattttatgggcaccagtatgattgagatcctcacgtttgagatagatcttggccccgcctaagtcttcggtcatgtttttggcgtaatacagtagcgatggtcgattagcataattgactaacaaatcgttgagttcggctttgaattgcgggtcgtcttttaaagtgttgaaagccgcggtgattttttcgagttcggtcattaaggtttccgggatatactggccgccaaagtcgttgccatagcggccggcgcggtttgtaggttgagcagtttcatttagtgttttcataagtgatttcctcttttgcgttttgagtaaattgatgaattttgtgcgcatctttgtgaccggcagtttcaacgccgctggacacgtcaacgatagtagggtggacgatttgaatggcacgggcaacattttccggcgtcagaccaccggctagaatcagtggccgcgcgatgtgtggaatagccactagattgagcagttggccactgccttttccgctgtcgaccatgagataatcagccggtgaagttaagtcaattgcctggcgttcaaagacctggatgacttgcaggccagcgtgttgcagctgcttaatttcggttggtgtacttgttcgatgcagctgcgcaatttcaatggcgccggcttgataaatcgccagaatatcggcgaccgattcatgaacgaaaacgcccactggttgaatatcaggatggagtaacttgcgtaaagccactgcctgttccagggtgacgtgatgccgtccgggagcaaaaacgaacccggcgaaatccgcttgagcagcattgatggctaaaatatcttcgggatgcattaagccgcagattttcacttttaccatttttcaaatccccctgaatgccgtaattaattcccgcttgtgcttggagcgcatgagggtttcaccgattaagacggcgttgaaaccggctgcagctaacttttcgacatcttgttgcgtttggatcccgctttcggcgataacaggaatcgagtcaggaaccatggcgcgtagtttcagactgtttgtaaaatcaacctgaaaatttttcagattccggttattaatgccgatgatttttgcgcctgattgcaaagcacgggtcacttcttcggcggtgtaggcttcgacaatggcttgcatgccgagatcctcagcgagttggcggaaggtgcgtaattgttgatcagttaagatggcaacaataagcaaaataatggacgcaccatttgccttggcttcgtaaatcatataaggatcaatcgtaaaatctttacgcaatgtcggcactgagacctgttggctgatcgtctttaaatagcgaagatggccgttgaagtaatcaggttcagtgaggacggaaatagcatcgacgccggcttgctcgtaagcttgagcaatcgccatgtaaggaaaatccgccacgatcgttccttttgatggcgaagcttttttgacctcggcgataacttgcaaaccaggctgctttaaggtggtgaggaagtctgattttgtggtcggtggttgatgggcaacgatacgttttagttcagttaaggattggtgttgttggcggcgagcaaggcggattctggttgctgcgacgagatcatctaagatcatgccaccacatccttacgtttggcagaaaaggcgagcaggtgatttaattcttcacgtgccttcccagcgtcaatcgtttccgcagcgagagcgatgccgtcttgaatgctcagtttcggatgagccagatgcagggcagcaccggcgtttagtatgacaatgtcacgttgcggtccgtgcttgccagcgagaatattttgcgtgatttgggcattttcttcaggtgtcccaccgaccagatcggcgcgctgactgcgattgaagccgaattgttctggcgtcaccgtatattgggtgagctggccggcatttagttcaaccacagctgtttccgcggcggttgtcatttcgtcaaggccgtcacgaccatgaacaaccagtgcattggtgacgccgagctttttcaggacgttggctagcggctccagcaaagtttcatcgtagacaccaagcagttggcgcgttgggtgagccggattcgccagcggaccgagaatgttgaaaatagttcggaaaccaagctgttttctaacgggagcgacatacttcatcgacttgtgatattcctgcgcgaacagaaaagccaaattgttttcctgcaggctttgataactgacagccggcgtttcgttgatatccaagcccaaagcttcaagtacatcggcggcaccgctctttgatgaagctgcgcggttaccgtgcttggcaacaggcgtaccggtcgccgcaacgacaatggcactggtggtggaaatattaaaggtgttggcatgatcgccaccggttccgacaatttccaaaacatccttggtttccggaaaagcgagtgcgtgccgccgcatagaagctgccgcaccggcaatttcgtcaatcgtcggtcgcttagccgttagcgccgttagtagactagcagtttgcacttcagacgcctcgccattcataatttcatccaaaacagcttggctttcttcaaacgttaaatcttcgtggttgacgactttttcaatagcttgtttgatcatggcgatccctccaaatttggttgtgacagtggcttggttgttgagaaaaaaggctaagcgaaaatggccatcgtttgatttccttggtttgtttcatttttgggggacctcctttgatcgttgagatgagtggttgttgttgacgtgcttcttcataacgcgcttgcagtcgccataatgcgttcgccagcccagaaacctgcatgtaaggaccttaaccgcaatggccaaagaccggccatcacggttaaggccacttacactccggtttctgaccaggctggcttacgctcacaaaaaaatccgcccataactaaaaactagttaaggacggattttccgcggtgccaccttagtttgatcgctcgagtcttcgacaaatagtctaacttgattgtctaaaaaagagtccgattgatcacgcttagcgagggaccaacatccctccgacaactgacgtatgcctgacgtttccccgtactcgcaagctttcgggagaaccctccgtggtccatttaatcatctgcgttcgattgcactctcagcaacggcaactctctgtgcgcgcacaatgatcttgatctccacatcaacggtttttcatggacgaaatattaatgattgattcgtatattagagaatgttcataaaaatgtcaacacttttaatttacctgcgtgtattcggcaccggccagttttcctctgtttctgaaaatagtgagactcgcacagggacgatatcgttttaaatacttttagtacgcaactgccgccgatccgtccagagcgcaacaggggaaagacataagacaattagagcaccagcaagataagtgtgactaaacgcgcgtgacaactgggtatttttacggtgcgttattgattgaaaagttgtttgcagcgtttgcttctgtgcaatttgtttgatgccgtttaaaaaggcggtctggttcgtgttgatggtcgtggcaccggtggccagtttggtgacactcactgacagaggtgagtggctttgttgcatcattttcgttaaagcggttagcccagttgtgaccttgatattagcgtggcgtaacgcggaactggcatcatatagtcgccgcagatcagttcctgtcgcgggtttgggtagattggttttcacttttgctgcttgagctatgacttgtttcattttttgttgctgatgagttgtcggcgtggatgagccggcgaaaactttccttaattgctggtgggccacgcttttgacgtagggtgagagcactttttccgttacgatttgatcgctggcatggtgaatctgggtcttagctgtgtcgatattggtatccagcactgttaccagaacggcgatgcctaggcaggtgccgatttggcgggcagcgttgacgattccagagccgatgccgcttttgttttttggcaggtagcgaaccgaggcgaccaacgagaccgaagcgaagccaaaacccatcccgttgatgatgagcagtacaacgatgagtgcggtggcggtgtcggttttaatgagcgaaagcaggaagagactggctgccatcaccagcataccggtgagtgtgaccggaatcgcgccgactttggcaaacagtcgagtcgcaagcggcatggcaatcatgatggtcagtgaaacggggataatgatcaaagcagcgtgtaagggactatctcctaagacgtcttgcagaaaataattcaggattaagctcggtgcaactaaggcaaaaccggtcatgaagtaaatcacactggacgcactaagcgttttttcccggaaaagattgagctccagtaacggatgccgaaccattttttcagtcatgataaagacaatgagtgctatcccaccgccaattaaactggtcaaaatcagtggtgaagtccagccgtattggcgaccttccaacagcccaaacgtgatgccgccaagtgcagctgtcagtaacagtaaccccgggaaatcaatccggccggcaagtgattcatcatacgattcttttgcgcacacagtaaccagtaaaaatgcgagaatggctagcggaatattaatcccaaaaatccaccgccaagaagctatttgtaaaatgatgccaccaatgggcggtccgccggcagctgccagcgcagtaacagcaccgaccaacgcagcgacctgattgattttttcttttccgtagacttcgatgcccatcggtaacacgattggcgtgatgatggccccgccaagaccttgaaaaaagcggaatgtaatgagtacgggtagcgagggtgcggtcatgcaggcggcagagaagcctccaaacagagccagacccagtaacatgatttttttacgaccataacgatccgctattttggaagccgtaatcataaaaaccgacatggcaagtgtgtaaatcgtcatgacccaactggtgttcgcaagtgaaccgtgaagctcggtcataattttgggaatcgcaatattcacaatagtcgtgtccaacgtccccataaacatggcaatcgtcaggccaataaaacaaagtactttagtcaagcgcgtcattgcatcagatcctttcatctgctacatttgtgtatatgtgacacatgtgtgactttcgaaagcactttgagtatactggggctaaagataagcaacaagggtttggtgacaagtgctacaaattgatggtgtttgtgtcagttaggagacggagaacatgaacggaaaacaacgcatggcgcgccaatcaaaacaatggttagtggatgcattagtgacgttgatgaaggatgaggcgattgaagatatttcgattacggaaattgtccaaacagcggatttatcaagaagaaccttttatcgtgcgtttaaaaccaaggatgatttaatcgattatctgtgccgccaactagcagatgattatttcaaaagtttaaaagcggccacgcgtgatcaaactccgattagttttgccaccacgatgcaaaactttttcacattttggtggcaacaaaaagaccttgtccggttgttgattcgacaaggtctgttcgatcggttgaatggcgtctggcaacaaaatgcagtcgcgcattatcgtgactttccggcgccgtggcatccgcaaggtacggatcaagaggtcaactacatcatggcctttgcacttgggggactcaccaatattttgcggctttggctagtccaagcgcatccggaatccccagaagaaatccagcaatgggcacaagctagctttgcacaattagcgcggagtttgggtggtggtgaaaataacgcgcctcatgaagcttaagggcgatcgtgcggttaaaagaagaaattgataggtaaagttaaatcggcattactaaatacgagcacgccgtcagcagcttttcccttaggtacatcgagtatgagattgatcgtcttttcctcgctcgtgttgataacaggtaggtttgatggtgtttcaatggcaactttctgattattcgcggatgcggtgaagtgactcggtgaaaagctaagcggaatggcgtaatggttattatggaaagttagcgagatcccggttttattttcgggcatgtttggcaagtaggcggacttaatcgtgaataatagttgtttgttatgcccgtagtaagcaactttgcgaccgatcgcgacgggcttgctagtaatggcactgtgcggaatagggtatgtggatggaacagtgatgacttttttgcttgtgcgctggcgggaggttgtttttaaaactaattttgtcgatgtagcgtgaagctttttcagcgtcacggttttctttgttgccttaccactggctaatggctggttattcagatcttttagcgagtatttagtgttgggtttgacttgaaaagttaacttaagagcgtcatgaacagtggttacttgcactttggttgcttgtggcgattgcgtttgggcgtgcgctgcttgctgaggggcgaaaataccgatgcccaaaaggatggcgaatatagtggctgcttttttcacagtgatccctccaagtggcgtggatttatggtatgtggctaattatagttgaactttggctgtggatactatctttttctaataatatcataaatatttgggggggtttctgtgactgatatttgtctttaaaataactcaaaagtagccatcgcatttttagcaggtttgcaatggccgcttgcttgagttcttttgccaatgagggggagatataattcgctgtttcaaacaggttagtttttgaatcctaaatgggcaataatagttcatttggcgctgcttttggaatagttttggtcatacctctttgccctgtgaaggttcctccgacacgataccaagttgctccttcattgctttaaagtaatttctttgatcgcttcgtgtgccaaaggttgattcgctttgggtcgtattttagcgtaccatcttcaccaagaacacggtcattttgattttttgtgtccatgttgagaccctccttgtaaggacatatacacgagttgagatgttagtacaagtatgaaaggtgcacttaaagaagcaatttaagctaggcagcacaaattaatgaacagttatcaaaatgtgacacttaaacggctttggataaaataaaccacactgatccagccttttcaagccaagcgagcgtaatattttaggttaaatgtactgcataatctcacacttgaaaaactcaatactgcaaatgatctttagatatttatttgcgactcgccctgtcagcttgtcaattaatcaagccaaggacacaactttgaccgcatccattgcttgtaccgttctcggacgctggcgtggttagcaatctttcctgaacgtgcaatatagtcacaactgatcaagccagtcaaaatggtgtaaccacttatcttgcgaatagataactcgattctaaaagggggttttgattctcgttattcatcccagacgttccactaaaatgccattatcgtcgatgctttcttccatcattgctttacgtaaatcgtagtcggaattactttcgaagatactatgcttaacagacaacagactgatgacaccattttcggcaatgataggctaatattcaacatttttaccaatattaaatgacgcggaaactgtaatcatagttgaatttccctgacggcgctttttaacagtcatgtttatcgttctttcccatgccatgaccatctgtgcagtttttttgtatcaaggtgttagccgaattaaaacatatagttgctcttgtaagtaagagcggtttgcgctattaataccttaaaaagggagtggattgcttatgacattagaagttgttcctttttcatccgcatcatccgaaattgatgggttgaagattattcatgtgaagatggtgacggatgagcgcggaacggttcgagagttgtttcgccagagccagcattcgcaagtgttagtaaaccctaatatggcttggaaacaggtcaatttgacccggactaagcgcggggctgttagagggttgcatggtgaagcgatgtcgaagctcgtcacggttgcccatggagaagcatttggtgcctatgtggatacaagacgggacagtcctactttgggttccgttgtcacggttcgtttaacgccaggtgtgcaggtttttgttcctcaaggcgtttgcaatgggtttcaggcggttgccgatgatacggaatatctttacttcttcgacaacgaatggcaaaagggaatgaccggtgtggcactaacacctttggatcctgatttggggattgagtggccgatcgccattaagcctgataatttagcgcaaatttcaaaaaaagattccgaggcgcctactttgaaggaagtgctgaaacaactggcagagacgcggccaaaggaataactagcaaggatagcgactgccaacccggttacatagtttatcaagtgacaggtacaaaaatatgatcctgagacgtcttttgataaaacaaaacgcgctgacccagcttttttaaagttggacgtcagcgcgttctttttgtttacaggaaattttccaaacccacaaccaaatgattcgctgcctgaaccttgcgaatggcaacggcgactccttgcatgaagctttggcgatcgaaggagtcttggcagatggtgagggcttcaccgggaccgccgaagaggacttgttcgtgggcgatgtaacctggtaagcggacggcgtggaccgggacgtcatcaatgcgttggccgcgggcgtcgttgtcgatggtggacaagggcttttgggtgcgtccggcggcgattttgtgcgcagtggcgatggcggtgcctgatggagcgtcggccttatcctgatggtgcatttcgataatttcggcatcagggaagtaggcggcggcttcctgcgcgaacttcattaagagaaccgcggaaaggccgaagtttggggcgattagaccgccgagatgacgggcttgggcgagttcgattaagcggttttgatcggctggcgtcatgccgcttgtgccaacgaccgggtgaatgccggctttgatcgcggcttcaatgttggcagcgacggcagtggggttggtaaaatcaacccacacatcggcaatgtcgggattgagctgatcatagctcgtgagcacttttgtatcagctggtagtccatatttttgggcatcagcggcaattgctttcggatcaaaaacggcacttaatgcgaaatctttttgtgactgaaccattttgactgttttttgacccatggcaccgcgaaaaccggcgacaagaacgtgaatcatgcaagcacctccgcttcaattgctgatagttccggaacccctaatagatgggctaattcctgttgttgtgccgctgttaatggcagtaacggtaaacgcgggctgccgactttgaatcccaaagcattaagtgcggctttggtaggcgctggggatggaaaatggaataacgcggccattttcggtaacagttgccgttgtaatgcagctacagtggtgatgtcaccgcgatcgagcgcacgatacatttcccggatgctatgggcatataggtgggaggcaactgaaataacgcccatcccgcccagtgttttgatcgtcagcgcttgagcatcttcgccggtccagacattgaaggcatcgtgtttggttcggtcgatgatatcgctgagtgctgccagactgccgcactgcttgatcccttgaatcatggggttttgtgccagcgttgccacggtttccggtaacatgtttacgccggttcgccctggaatgttgtaaataatgatcggtttttgcgcacttgccgcaaccgtggtatagtgcgcgatcatgccatcttgatccggcttgttgtaatacggaaccacaaccaaagtagcatcaattccggcaattccaccgacttcatgcgtaaaatcagtggtttcgcgggtgttgttagaccctgaattggcaatgacgagtgcgcgcccgtgaaccatggccacaaaacgggtgtaaagggtgatcttttcatcatgactcaacgtaggcccttcacccgtcgtagctccaaccacaaacccgtcagtgccttgatcaatgagatgatcgactaaccgttgcatactatcatagtcaatttcatcgcggtcgttaaacggtgtcacaatcgcggtgattaattctgctctttgcatttaaaaaccccctgagcgcgagccggcgcgtttagaagtcggagtgtaagcggccttaagcgtgatggcccggtcttggccattgcgcttaaggtccttacacgcagacttctgcgccggggagcgcgttaaagtgagcgtgagccagcccggttagaaaccggagtgtaagtggccttagccgtgatggtcgggctttgaccattgcggctaaggtccttacacgcaggtttctgggctggcgaacgcgttatcgaaagcgtaagccgccttttatgccagcaaacgcgtcatgttgaatccaatcggcaagccatcaccaaaagatccgtgactgtccttgcacgctatcaatcaagatcctcagccgcttccgccatccgatgcgtcagaaaatgaatgatagccgtcacacctggcgctagagctgcttcatctggtgaaaagtcagcggcgtgcaactgcgaatccggatcattcacgcctagccaaaacatggtgccaggaattttgtttaatagataaccaaagtcctcaccggtcatgaccggatcggttggcacaaaggttacggctgggtcggcttgcatgaaatcaatgaaatcttttgtcagttgcggattattttcgacgggataataaccgccttgattcaaatcgactttgacttcgcagttgaaactagccgcgatgccttgaccgatatcccgaattcgctgttgtaagaaattaatttgcttttgcgtgaagccgcgcaaggtgccttctagatgggcgctgccggcaatcacgttgcggatggttccggcgcgcatgaggccgaatgtgatcacggcgctatcggtggggccgacattgcgagcgacaaccgtttggatttggctgatgaaactggccgttgcgacgatcatatcgttagcattttgcggtagcgctgcatgaccgcttttaccgattagatcaacgttaatctcagtggtgccggcaaaaagcgttccgagccgcgtgttaatcgtaccagcaggcaggtcaggccgatcatgcaggccataaaattcatcaatctgccactcaccggtgaaagcgcccatgtcataagccagtttaccgccattcttgctttcttcagccggctggaagaagaaaatcagatgatcctttggctgatgaacggcaaaataactgagaacgccaagtgccacggtcatatgcatgtcgtgaccacatgcatgcgcaatcccctgatgatgcgaggcaaacggcaaaccggttgcttcggtgaccggtaacgcatccatatcggcgcgataaccgattgtgcgttgcggatcggagccagtgactttgactagaatggcggttggtaacttcggtaaggtacgaatggtaagaaaagtctgcggaaaactttggatggttttgagcaggaaggcatgggtttctttttcctgcagcgctaattccgggatttggtggagctggcggcgaatagcaatgagttcggcttccttcattaaatgtcacaactttctgagttcatcaagcagcaccgtcttagcttcggtttgatcgttgacttttttaatcaccttggctgggacaccggcgacgactgtatgggcaggaacatcattaatgacaacagcgcccgcagcaatgacagccccttcgcccacggtcacgccttcaagcacaacggcattggcaccggtcatcacgtgatcaccgattgtcaccggcttagctgacggcggttccaccacgccggcaagcactgtgcccgcgccgatatggcaatgtttgccgacaatggcgcggccgccaagcacggcccccatgtcaatcatggttccggcaccaatttccgcgccgatgttaataatcgcgcccatcatgatcaccgcgttgtcaccaatcagcacctgatcgcgaatgatcgcaccaggctcgatacgggcattggttgttttgatgtccaataatggcaccccggtgttacgaccggcagcctcgacatagtaatcatccagtttagcggtttttaaaacgggctgaatctctgcccagtcaccgatgacagtgccggtgtgtttgccaataaatgcatggacacttttaggaaaatgcaagtcggctaatttgcctttgagatacactttgaccggcgtggttttcttgctgtttgcgatggttgaaatgattttttcggtattgagttgtgccatgatggcctcctatttttttgcggcagtagtggcggttgatgtcggcgctggttgacttggagcggtgtagtgctgatcgtgttgaatcaaatcggcgtaagtttcacgcgtgaccaccaactgtgcctggccatcttcgacaaaaacaacggctggacgcgggttgcgattgtagttggacgccatcgagtagccatatgcgccagtgtcgaaaacggcaaccacatcgcctggctgtgtggctggcagcggggcatcgtcaatcaaaatgtcgccggattcacaatactttccgactaaatggacatgttctgtgggctgggcagtcgggtgatccgcaaccacagcggtgtattgagcctgataaagggcagggcggatattgtcgcccatgccgccatcaaccgcaacataaggccgcaagcccgggacatctttgcgactgccgaccgtatacagactgtagccggcaggaccgacaatcgaacggcccggctcaatccaaacggcaggcaatggccagttgaaaccgtggctttgggttttcagggtggtcacaatcgcctgcacaaaagcttctggtggtagtggatcatcctgcttggtatacgcaatcccaaaaccgccgccgacattgaggactttaggggtgaagctgaattgctggtgccaatgatcaaggactgccagcagcttttgggtgacggcttcaaacccggcgacttcaaaaatctgggagccaatgtgggcgtgaatacccagcaaattaagatgatcatccgccagaatacgcttggctgcttcatcggcttgcccgctttcaagatcaaagccaaatttactatcggtttggccggtttggtcataagcgtgtgtatgagcactaatccccggtgccacccggatcaagacgttttgcttgcccacggccgcctttagcaactcgtcaagcaggtccaattcatgaaaattatcaacgatgatcgtgccaaccccggcgtctaaagcttgttccagttcggctttgcttttgttattaccgtggaagctgaccttttccatggggaagtccgctgcttgagccgtgtataactcgccaccggaaacaacatcgacatgaatggcttcggctttggcgacctcatacatcgcgatggtagcaaacgccttggaagcgtaactaacggcgtatgcgactcccgccgtttcaaaaacctgcttgaacgcccgaatctgatggcgaatggcgccaacgtcataaacataaagcggcgtttgaaaagtgtgggcaagttgactggcagcaatcccgccaatcgttaattgaccttcgtgatttgtggcaaaattcattcagttcatcctcccgagtgatggcagggcaacggcaaacgaaaagggacccttttgtttggccgcgcgtcaaacaaaaagatcccaacttgcaatctacttgaatgatagcgccccgcttagatacctaagcgacagtacaggatttattcaatcctggcccaacaggctcaccgatcccggatcacccatttcggcaaccgcccctttcaccgaatgtcaccacgaaggatctcgctcgattcggttagtcatgttggctgcaacctctatctgtttaacaccacattataataaaaaacggtacgcgtcaaatttttgtgagcgcgagccggcgcggttagggaccggagtgtaagtggccttggtcgcaatggcccgggtctggccattgcgaccaaggtccttacatgcaggtccctgcgccggggagcgcgttatgggcgtaaaagcggacttgtggcctcaggcgtaatggcccgggcttggtcattgcgcccaaggtccttacacgcagactcctgcgctggggagcgcgttatgggagtaaaagcgaactagtgcccttagacggtgatggcccgctcttggccattgcgcttaaggtccttacacgcagacttctgcgccggggagcgcgttatggtgagcgagagtaccttgctcagagaccaaatataagagcctcaaacatggtggctgacgcttactttctatttcttcagcgcgaacagtgtgactgtatgccaaagaaccatcttgacagcctgattcccaacaacccactttcaatccgtcaccccaatacctagcaaaaaattaaaaacatttttaagctcattattactatgcaatggcgtcaaaaaatgctgttttggcgggatggtgggggcttgtgtttctctgggagtctgttaaagtacagaataaaatgacagagttctcatttgcattgccgtctgttgatgccagatgaaaatcacttacgcaatcgctgtcggttggtgattggcaaggttgttggcgtcaaggatacactggaaaatggggttagggaggcagtttatcgtgcgtgtcgtaaaatttggcggttcgtcattagcagatggagcgcagtttgccaaggttgtggcgattatgaaggcgaatcctgcccggcaggttatcgtaaccagtgcgcctggtaaacggcatcccggcgatgtcaaggtgacagacctgctaatcaagtacgcccaagcggtgttgcagcagggtgaaacggctgcaatcgttgctgaaattgtggctcggtatcaggccattgccacggcgttcaaccttgacgcgcaagttgtggaaaaaatcgaaaacgaactataccagttaccgaataccagctttaaaaatgccgactacctaatggctggcttcaaggcacgaggcgaaaaattaaatgcttttctcatgacggcggtgttgaatcacgaaggtatcgaagccacgtatggtgaaccgaaaacattaggaattgttgtaacggatcatcccaatgacgctgaggtttcacgtgaaacttacgatcgtttggcggcatttcggcggccgcttggtgtgctggtagtaccgggattttatggctataccagtcacggcgatattgctactttttcacgtggcggctcggatattaccggtgcgattttagcaaacgggtttcatgccgacctgtatgaaaatttcactgatgttgatggcgttgcggctgctgatccacgggtggtggcaaatccgcagatgattcaagaaatgacgtatcgggaaatgcgggagttatcatatggcggctttggcgtttttcatgatgaagcgattctaccggccattgcgggacagattccgattaatttaaaaaatacgaatcatccttctgcccctgggacgatgattgtcccggaacaacattttgtgccgaaacatgcgattaccggcattgtcagctcgcaacattttggggcgatctatctgcatcgttatttactcaataaggaagtcggatttacgctcaagctgctgcaggttttggcgcgacatggcatcagttatgagcatatgccaagcgggattgacgatttgaccattattttggacgatcggcagctcacagaggcgaagcgtaaggccatttgtgctgaaattcaggaagttgtacacccggacgttttgaagtggattgacgattatgcgattatcatggtggtcggtgaagggatggcacaaagaaccggattgattcagacgattttgcagccgctagcgagtgccggggtgcatgtgtcaatgattaatgaaggggcctcccagatttcactgatgcttggcacatcgcgggaatcggcgaatcgggcagtcaaggccatctataacgcctttttcattccgatcaatcagcgcttggaggtgcagtgagtatggtgacattacaaaaagttcatggctctgaaaatagtttctttttattagatgaaacgcaattgaaacagccattgaccacaagccaactggcagcttttaccaagcaggtgacgaatcgccaaactggctggttaggcggagcggatggcgttttggcaataacggatgcgcccgggactgctggaaaaatgacggtggtgaatactgacggcagcctggctaaattgtgtggcaatggtttacggacagttgcccgctatctaagtgaaaaaaccggtcaatcagcattcaaggtgcatacggattttgccgacttggccgttgcaaaacagtcgccattagcttccggcgttccggcatattcagttgaaatttcgccagtcagttttgccgccgctgacttgccatttgccaatcttggcgttgaccgcatcgttgacactgtcttgccggctattcatcctagtttgaagtttaccgcggtggcagtacccaacccgcacttaattgcatttgtgtctaaagaagaactggccagtcctgatctggagcgaattggtaaaatgttaaatgccaaaaatccgtattttccggaaggggttaacgtaacgtttgccgaaatcttaggtaaggacaccttgtttgcccggacttatgagcgcggcgtcgggtttaccaatgcatgtggcaccgggatgtccgcaacgaccttagcgtttattctgactcatccccaggaggcggcatttgaacgcgtgaataccgtgtataatccaggcggcatggtgaagacgatggttcatcatgatcacgagcgttactggatcgaactcatcgggaacgcaaccgtgacggcgacaatcaccgtaccggatgaagcgcttgaaagtggtaaactgacacaagcaactttccaacccactggcgagcaggcggcttatgagcagttcattgactcattgccgcatcgagatttggcagacacattaatagaaggagcataaatcaatcatgagtggttatcacgtagcagttgtaggggcaaccggcgcggtcggaacccggatgttgaagatggtcgcagaaagcaagctgccaattgcgtcagtccttgccttggccagcaaacggtcagaaggtaaaacggtaccttttcgtgacgggacgttaacggttcatgaaacaactgatgatgcgttcaaggggattgatattgcattattctcagcaggcggctcggtttccaaacgatttgcccctgcagctgttaaagccggcgcggtggtcgttgataacaccagtgcttttcgtatggaacccgatattccgctggttgtacccgaagtcaatccggaagccctgcgcacccaccacggcatcattgcgaatccgaactgttcgacgattcaaatggtgaccgcacttgagccaattcgcaaagcattcggcctgaaacaagttgtcgtttcaacctatcaggcagtttccggcgccggacagtcagccatgaatgaattgtttgatgaaacccaggctgccttggacgataagccattggagcctaaaattctaccaactgctagcgacaaaaagcactatccgattgctttcaacgccttgcctcaaatcgatgtcttcgaaccagacggctatagtcatgaagagtggaaaatgattcacgaaaccaaaaagattatggctggcgacatgaacagtgatgcgatcaaagtcaccgccacttgtgttcggattccagtgccaattgcccattccgaagaagtttattttgaaattgaagacgctaacgccaccgccgacgacattcgcgctgcattaaacgatgcgcctggcgttgtggtgcaagatgatccaagtcaacagctctatccgcaagctatgaatgcagtcggcagcaaagaggtcttcgttggccgtattcgcccggatgctgaaaatcctcggttcttccacatgtgggatgtttccgacaaccttcttaaaggagcggcatggaactccatgcaaattgccgaaacgatggatgccatggggttaattcaaccgaaataacgaataagtttaataaagccatttgcgtagtgcacgtcaaaacactaggcaaacggctttttgttttgcagcggggggacaacagacgtaacatgccagcgtcctctgtaaataacgcctctaattcttgctagaagcttaagatgctgccaaattgattgacggatttcttaaaataactatactgatgaaaaacgagtataggagcatgttacatgaaaaagcatcgtttcgtcatcgcattgatcggcttatcactttttgcagtcagcagcactgttgccgccgatatgacgcaagccaatatcgatcagcaggttgtccaatacacgttgaatggcaaggggctggtcattttcaatcatgcgcgcacttatcgcacgaaaagcacagccgcagtttatcaaggctcctttgctgcagatgcaccgacagcaagctttaaaaaggtcggcaacctgaccaatcataaagattatcgagtaacgcgtaagataacagccaaggctaagttgaaaggatcggccacgcagactttttactatgtgtccgggcacggttgggtgaaaggcagcgacttgacgcgatcgtgaactgtgtcttcaatttcagggaaatccgtgtagcaacgcagctaagattgcgtgaatctgtacggatttttctttttgactaaaattggtaaagttcgatcttgacaacctgtatctgctattctatcttgaaaacaatataaagcacgttaaccatttattattggcgatattgagtgataactaacaatgacggttcatggtgaggactttacggaggcgagcagcacatgccaataggcgaacaaattaaagatagacgcgaagcattagcgtggagtagagaagaattggctcaagtggtcaatgggtcggtacagcaggtctcaagatgggagaagggcatcagttatcctaatatcaagcaactgattgcgattagcgacaggttagagctcagtttggataacttgatcaaaagcgatcccaaattgcaaaagacaattcaaattgataagaatgccaaggaagctagtgattatctgcggatctctcttatttttagctttacatatatgatcttatttagctttgctgctctctttatgtaatagcgaacgtaagtgttgtcaacatcagctgtttatatcaatagtgatgtgttttactcaaataatacctcaccttgatttcgatgaggcgttgcaatgctcgggatgatttgatgacctttttgtggcaggtaccgattgtactgtatggcattgtacttggctgataaacataccttgtcctgtatgggatgaggttttttcatttgcagtagaattaacttcaattcgatcaaaaagccatcatgaacctgaatataaaaatcgttgacctgcctgactgtgaacgatacaatcaaactccgacttttaaaaatgaagaggtgatttgatatggtaaacgtttactttggcccaatcccgcagaggccagattcggtgctggtgttgcagttttatcatggcagactcatttgggtacataatgtgaaacggaaatgggagctgaccggtggtaaattggagccaggcgagacggttattcaggcggcggttcgtgagtcttacgaagaatccggcgcaatcgtcgaacccagtgcgatttcgtcgttgggctactatgttttgccaaccggccatgtaacggcagttgttcaagcagaggttttacgtttagaggcgatcccgacgacttctgaaaccgatgatcgccgcttactttttaaaccggtaccggatccggaacaatcttttcatgatcatatttatcggcagatttttcagcacattgggtggccccatgagtaagcggcgcgtgggcttgttactgaatcttttgtcagtggcagtgatggcagtgacaccggtgatgaacaaatggtcgatgaacaccctgtcgccgctagctgcaagtttttataacgcgcttgtttcactcgttttgacttttatcacgattggcgcaactcatacaaaattggtatgggtgaaaagccccgttatttgggtattaggactgaccaactgtttaggcattgttttgcagtatttgagtcttttctttcttgatccggtgagtgtcggattgattggccgcttctatattgtttttgcaattttattgtctgtattcttgttgcatgagcggtttgatcgccgagaaatagtgccgattgggttatgtattgccggaacagcgttggtatccgatttctccgggcgtatgactgacatgctcggactggtttgtgcgtttggctacacgtttagttttgcgttaaccaacacgctggcgaaaaaggcattggcgcgcgtcgatgaaaaaattttacttttgtacaaccaagcaaccgcagtgatcatactcggcattgttgcagccggcagtggcaagttagctttttcgcccagtatgggtattggtgccgttgcagtctcggctttttgctccggatttctgggtctgctgctgttttaccgcgggcttaagtttatctcatttcgcgatgccaatttaattcgcgcactaaacccagtatttgttctcgtatactcattaccttttttccgaattcaaatgacgccagcgtttatactcggcggcggattgattatcctatcaattgtctggatgcctttgccggtgaaaaaacgtccggcgattgggaaggaaaactgacagtgaggccgctattttttgaagtcatttttgctaggattttctgaaaattaacgttaaattgggaaaacacgacgtttatttggacgatgccacaacttcatagaattattttacactagggatagtaagggaaaaaggtacctaaaaagcagtttaacagagccagcggttgttgaaccgactagtcgtcttggaagaaaagacaggctcgatcttgaagaagtttaagttggaaacaacaaaaatatatctttattattatgcttgtcagcaggtaactcgatcggtccgtctcacagtatggttgggttaggtgtcacgttttttggaggtgaatacttatcgttgatttaagggaagacatcatcgctacttgcgtctttacggtatttctattttgcgttgatttaatcctaaaggctccgctgcagattattagaaatctgttcactgggctgcttttctttgtgattatgttactagttcaatatttatgccgtaaaaaaacatgatgttcatgaggagtctcgagggggtgactgaacgatggtttcaaaaatcacttgtctcacaacgaagcgttaacgtgaaatcttacgttgtcggatactaatcgttgataatatcttttgttagatttaatatcaccccaaagttcagcgttgcgttcattgcttagatcaatgattgaataaggttgttttgcaaaggggattgatttgaagaaaaccaaataatgtttatacgtgaaggcaatgctgtatgcagcggccttcttttttcgagggtaggaatgaacgtaactgatttttgcgtttgggtatttctttttaagtttcctcaattgcctttttgttggtctatgggtaagaactaaatgacgttgcggttttaaaaagggaactcttagacggagaacttgaggaaaatctagtttaattactttttcaatattgtattgtgtccgtaactttgcaagctttttgtttttgggagaagacaaaaaaagaatttgtttagaagaataaccagggtatccatataagaatattccgataatggttaataccaagatgggggagaaaataagcacgaggaagaatacaaagtacaaaatgtctgacaggcttgcaaacatatctcgccaaattagttctcccagtaacattaaacttgcgtagattccaacaacaactctgacaactaatatgattcttttttcaaagggaattgtcgttagcaaaaccatagattggtgaatgatgccaatgtaatccttgaaagaaatatttgagacaaacaatactagctcccccctttttaaacggaaatgattctccttatcgaatatatgacaatctagatttaattaattgaatagtcgcatcttcgactattcagatgatttgtcctgaaatcgctacgccgtaaaagaagtacagtctaaggttgatgtaactcaagttaagtgaattctaacatgaaatcgtcatttcagtacattcaagaatgtacagagtaagactaataaaaattgcctgtcacgaacggataagttctcctaaaccctttgaaaacgggaaaagtcagctattaaagcgtcaaggcccaaatgaatcagttcctgcgtgctcttttacgtccttgctgccagaatccgcttgcacagtatggtagaatagctaaagaaatccttaagtatctgcgcgaagtgaaagcgagtttttctatatgaagaaattgtttgaacggatccgtatgcctgagttcctggaagacatgcggatgcggtatgcagcgattgcgatggttgttttggcagtcatcggtattttaattggcgcgttgattcggccttggttggctttgttgatgctgctgattttgatcagtctggtggcgacgattttttatgcccttgagacgattgccaagaatacgaatcagtatatttcagatctcagttatcggattaagcgcggggaacaagaagcgctgattaaaatgccgattgggatcatgatttatgatgaagacttgaatatcgagtggacaaatccgtttctgcagaagtattttggcgatacggatgtgcttgggcagccgctggaaaaagtcgatgctgaattggcagaactcattcgcagccatgaagacaccaacgaaaccaagatggtgacatggggccagcatcagttcgagattattgtccaaaagagcattggcgttgtttatctgatggatatcacgcgttatgccgagattgaggagcgggccgaagacgagaagatcgcgattggccagattttcattgataactatgatgaaatcacccagacgatggatgatcaggttgtcaccaacttgaatagttacgtgacgaatcaactgacagattgggccaatcagtttggcatgttcttaaagcggattgacaacgatcgctttttcttactggcttatgccaaatcattacgtgatgtcgaacgggataagtttaagatcttggacgtgattcgggaagaaacctcgaagcagaattatccattgacgctatctgtcgggattgcatatggcgatgaagatttggcacaattggccgtcacgtcgcaaagcaacctggacttggcgctgggccgcggtggcgatcaggtcgttgtgcgggcaaaaggacacgaggcgcgcttctatggtggcaagaccaacccgatggagaagcggacgcgggtacgtgcccggatggtggcgcaggccttgcaagagctgtttaagcaaacggataaagtcttcgtggttggccacaaacggccggatatggatgcggttggagcagccatggggattcgccggattgcccagatgaatggcaaggagtgttacattgtcattgacccagatcacctgcattccgatgtcgaacgcttaatgggtcaggttggtcaggatccggaagttgctaacgccattgtgacgccggaagcagcattgtcacaggctaccgatcagagtttgttgattctggttgatcatagcaagccatcgatttcagccgcgcctgatttgtacaaacgtctggctgcccgcaccgtgattatcgatcatcatcgacgcggtgaggaatttccggacaatccaatgttggtttacatcgaaccgtatgcaagctcgacttgtgagctgattgcggaaatgtttgaatatcagccaaccaatgtgccgagtcttgataagcttgaagcgacagcgatgttggccgggattacggttgacactaagtcgtttagcttacgcaccggaacccgtacatttgatgccgccagttatctgcgctccatgggggcagacgggatgctggctcagaacctgctgaaagaaaatatcgacagcttcattcagcgcaaccatttgattgatacaattgaaatgattgccccaaatatggcactatgtactggggaagaggacaagcgttacgatccggttattgcggcacaagcggctgatacgatgctgtcactaaatggtgtcgatgccagttttgtcatcaccaaacggccaagcggcgatgtcggcatctctgctcgctccactggggatgtcaatgtacaggttatcatggaagctatgggcggcggtggtcatttgagcaacgccgcaacacagatcaaaggcaaaaccatcgccgaaacgcggaccgaattgcttgcccagattaagaaagcagacgaagacgcatagaaagcagggattagtgatgaaagtcatctttacacaagacgttcgtggcaaaggcaatcgcggtcaggtgaaagaagtgcctgacgggtatgccgagaactttttgattcgcaagggtttagccaaggcggcaactccgcaagccatgagcgccttgcgtggccagcagcggcttgaagaaaagaaagaagccgagaagaaggccgaagctgaagcaattaaagccaagatcgaagacgacaagacagttgttcagatccaaagcaaggccggtgaggattcccgattgttcggttccattcctagcaagcaaatcgcaaccgctttggacaagcagtatcagatcaaggtcgataagcgcaaaatcgacctgaagcagccaattcgttcgctaggattcaccaatgtgatggtcaacctatttcctggcatcgatgcgcgaattcgcgtgcatgtgattgaacagaaataatttgtagcaagaaagggactgcttcggcggttctttttttgtgagcgcgagctggcgcggttagggaccggagtgtaagtggccttggtcgtgatggccgggttttggccattgcgaccaaggtccttacactccggtccctgcgccggggagcgcgttatggagaagtgcgagttggcccggttagaaaccggagtgtaagcgacctcaggcgttatggtttgcgcctgaggtcctttccttacacgcggacacccgcgccggagaacgcgtcagatgaccgctaccaatgtatcaatatatgatgagcgatacagatgtgcaaacgcttgtttcggtcagcattttaacgtagactgttagggataagcggttaaaaatgagccgattaaattgaaggaggacgcgcatggataaccagttaattgaacagcagccgccgcatagtgatgaagcggaacgtgccgtccttggcggtatttttctgaatgccgacacattgccggatgcccaggaatacgtgacggcagatgacttctacaaaaagtcgcatcggctgttatttcaggcgatgacggatttacaggataatggcaccgcgattgatacggtcacggtgacggattatctggacaatcacaatcaattggatgacattggcggagctggctacattaccgacttggtggcatcaacgccgattgccagcaatgttgtgtattatgctaaaattgtgcagcaaaaaagcaccttgcgtaagctcattagcaccgcacaaagcattgccagccgcagttatacggaacaagacgatgttgaagggctagttgaagacgccgagtgccagatcatggacgtctccgagaatcgtaatcaggcagggttcaagcagattaaagatgttttgaatcaggcgatggcgcagatcgatcagctctatcaaaacgaccaaaccatcacaggcttgccaactggttttcgcgacttggacaagattacaaccggcctgcatgaagacgaaatgattattctggcggcacgtccggctgtcgggaaaaccgcctttgcgttaaacattgcccaaaatgtcgggacgaaaacggacaagagtgtggccattttcagtttggaaatgggggctgaacaactggtcaaccggatgttgtgttcggaaggcagcattgacgccaatcatttgcgaaccggccaactgaatgaagaagaatggcagaacctgattattgcaatggggagtctgagcaaggccaagatttatatggatgacaccccggggatccggatggccgagattcgtgctaagtgccggcgactagcccgggaacaaggcgacttgggactcatcatcattgactacttgcagctgattgaaggctccggccaagaaaatcgtcaacaggaagtcagcgcggtttcacgacagcttaagaaactggccaaagaattacatgtgcccgttatcgctctatcgcagttgagtcgtggtgtggaacagcggcaagacaagcgcccggttctgagcgatattcgtgaatccggctccatcgaacaggatgccgatattgtcgcgttcctataccgtgacgattattatcgcgatgcagaaggcgatgacgacgacgatcaagacagcggcgatgagggtgatgacaatgttggtgaagttgaagtcatcattgagaagaaccgttctggtccgcgggggacggttaaactgctatttgtgaaatcgtacaataaattcacaaatatcgcctataatggcccggatcagtaaattgtatttagaagattggacaaacaacgaccattgacgaacaagaaagtgagggatgccgcatggatgccattttaatgagtttaatgacagcactcaatgaacacctgctgatcaacgtttaccagcgtgataccgatgatttttacactggatatgtgcaggtactgggtcacgatgcggttgttctgggaacttataacgattcagggattgcggatggctgtgctttgattgccttttcagcgattgatcaggtggaatttgccggggatgatctcgacaacatgaattttcggattgacttggcacagtcggagcattttttgacacttcaagggaaagaaacgccgtacaagtttgacgccaccaagagtttgatctggcaattggcgcagcaggcaaaagcaagcgggcagatgatcatggtggttgttgctgacgatgacgcttatctcgagggccgggtcaccgcggtggcagatgatcgctttagtatggcgattttcaacaagtttaactatacggatgtccgtgccttgcaagtcgacttttccgatattttagtgatggaatttcacggcttggatttgaagctggaaaccgagctagtccgcaagcgcgatcaactacaccacgtcccgaccaagctgtatcaaaacgacggtcaacttgaaggggtgtttcagaatgctttggcagagaatcggttgatctcggtggtgccaaaagggcctgaggatcagttcttcgtcgggcgcgtcaaagcggttaatgagcatgtggttgtcctcagcctcaaggatatggcgggccagtttggcggctacattctgatgaccctaccaagtattcaaaatgtggccaccgcatcggattatttgcagacgatcggcttttacgagcagtgggaccaaacccatcatttcagccagcagccagtgttaaatgctgatcgggaattcgaccctaacgataatctggttaaggcgatcatctccgaggcagccgggtttgaacgggtggtacgcatcaaggttgcggatagtgatgagcattttctgggctatccggaacacgttgacgaaaccgacttcgacttgaatctggttggcccagacagcggtgaaacggttcgcattcgttacggacagattcgtgagattgcattcgggcatatttttgcttatctgcaagaggcacagttgaaaaatgctgaccgttaatggcagtttgttaacggtacggatgttggtggtttgaatatcggtgtggggcaatcaaaaaagcatggttttcacggttaaagtgaaaatcatgctttttatttgctaccgatttgcaccactatttgctagtaacggtaagaacatcatcgcccgctgtggtggtccgcggggtgaagtcggttaatgatgcgacgtgatccatgttggtaatgatggtcatcaccgttgtctttttgcccgcggcttgaacagcggctaagtccatggtggcgattggctgaccggctgtgaccgtgtcttgatccttaacgctgaaggtgaacggtgcgccgttgagttcaacggtgtctaggcccatgtgaaccagaatttccaagccggttgcggttgtcatggtccacgcgtgcttggatggcatcacactaacgatggtgccggatactggggcgacaatcgtcccggatgtcggttcaactgcgaagccatcaccgaccattttttgagaaaaaacgtcatcttcaacggcggaaagtgtttctaattgaccggtggccggtgcgacaaattcggtggtgccagattgagtggtaacaggggttgcagttggttggttgaccggttcaggttgcggggtagctgtttcgatgaccgtgccgtcagctgtggttgcgaccatcgcactcttaggaaccccgaagaagtaggtggcgatgaatccgcccacgtatgaagctaaaaggccaaagacataacccagccactggtggttagcgatcaacgggataagcgctgctccggatggcccgatggtgatcgcaccgacattgccaaacagtccgatgaccgcaccgccaatgccgccgcccacacaagcggtgataaatggccgtccaagtggcagactgaccccgtaaataagcggttcgccaacgccgagaattccgactggcaaggcacctttaatcaaacgggttagttgcttatttttgcggcacttgatccacaaggctaacgcagcaccgacttggccgccgcctgccattgccagaatcggcagcaaggcggtaaacccgagatttttgatcatttctaaatggatcggcgtgagaatctggtgtaatcccaacatgaccattggcaagaaggcaaggcccaaaacaaatcctgagaacggaccgccgacttgaagaatccagttgatcgagccgaccagtgacgttgaaagccagccggcaaatggcataatcaggaaaatcgtcagcaccccgatggacagcagactcagcatcggcgtgaaaataatatcgatggcatcaggaatgaagcgatgcagttgcttttcaaccagtgaaagcagccaaactgcgaagataacgccgatgatgccgccttggccagctgctagcggttggtgggtgaagatgttggtgatggtcacgggcgcaacaacccctggcaggtaaatcagtccgccgacaatcccgccaagcccggctgtggcgccaaattccgttgcggcattgattccgacataaatattcaagaaagtgaaaagaccgccgttgataacttttaataccgtgatgaattcggtccaacttttcggtagatcaccagcagccatcatgttgaccagaatgccggcaaccccggaaattaaaccagcgccgacaaatgccgggattaacggaatgaaaatggcggagatgtgcttcaaagcggctcgccaccacgtttgtttcagtgcggctttgtgagcggcatgaacttcggcggccttggcttcaaccgcagacttgttatcttgatggtcattgccaaccgaagcacttcccggaaaaggatcacctaagccaacgccgacttttgcgaccatggcctgcgcgactttattaacggttcccgggccgacaatgacttgtaaggtttcttcctgaacgacaccaaggacgccgggaacttttttcaagcctgcgacattgaccttggcttcgtctttaatggtcatccgaactcgggtcatgcagtggattaattttgcgacgttttgtgggccacccacctgtgcgtagatgccgtcccccattgcttgatacttatcttgccccatcttctgtttcctcctgacttaacgcaacggctttactaatgaagccatttgcttgattgagtaatgtttgtgcggtggtgctaggttgattcgttaagatcatgacgatggctaatttgacatggcgattcgccgcttcaaaggctgtttgtgcggttttggcatcgcatccggttgcctgctgaataatgcgctgactgcggacaaccagtttttcgttggtgggctgaacatcgaccataagattcttatagactttgccgatgcccaccatcgcaccggttgacagcatgttcaaaaccagtttctgcgcggtgccagccttcaagcgggtggaaccggttaagacttccggaccggctggcacctcgatggcaatctgagcatgctggctgatcgcggcgttatggttgcaggctaggctgacagtagcggcgccgatggattgcgcatagtctagcccgccaatgacatacggcgtccggccactggcggcaatgccaacgaccgtatcgtttttagttaattgacgttcttttagatcagactggccaagcgcaaccgaatcctccgcgccttcaacggcaacggtcatcgccttcataccgccagcaatcagtccttgaaccatttctggagcggtgccaaaagtcgggacacattcagccgcgtccaataccccaagacgtccgctagttccggcaccgatatagaaaagccggccaccgcgtttgaaagaagtcgtgatcgtttcaattgcggcctcaatcgcaggtaaagcatggctaacactctgcgcaacggtttgatcttcggcattcatgaccgtgacaaaatcatgaacactcatggtatcaagttgcatcgtcttttcattacgggtttcagtggtcatttggtctaagttaatggtcgtcatgttaaggtcctctttctttgtgagcgcgagccagcgcacatcatgatattttgaatcgaatcgcctgatgcggtccgatttgatcaagtaacggtaaattagatggttcaattttgccaatcacattcacccgtggatcggctggtaagtcgcagcgcgtcagctgaagctcaccggcatagcgaccatacgcgctattatcaagcgtgatgctgccgcggggacggggatcggtttgtgccggttgtggcgtggcaaaaatgtgttccagccgagcctcggccaagcgcacgactttttgcgcgatgtccgggcggctatgccatgttaggtggagcaggcgttcatcgtcagtctgcacctggattaaaagtacctggtcgtggacatatgcctgaaacgcggcaatactacgcgggctgagttgcggatcgccgacataaacatggtcgatcgccagttgcctgagttccagataggcagcaagcggaagtaagccacggtgagcttcaagtgttggtaaaccagcgaataaaggtccgcgttgttgcgcatcgccggaaataaatgccatggttttaaacccaagtgcgtgcagccatttatttttttgcgcaaaccatgccggatccagtccggtttccggtcgtggataaaagttgtgccaggcttcgatatggcgcagattggccttagcgttggcaagctgatcaatcatgcaagcggaaagtgtgctggcattgagcgcaatcgccatggtgtgtgacaacgcggctaccgtggtcatgtcaatgccgtcatcaatccgcaaaccgtctaatcccaacgcttgaattgcttttccgtcgtgcagtgcgatgcccaagcgttgcaaacttgcagcagagacatctgccataattgtcagtccgagttgatgacaattggcaaccaattgatccaaacgctggcggatgatttccggtttggcttcggataattgcaatgaggtaaagaccccagtgaatccggcttgctgcatctgtttcagataagcggcttgctgttcggttgccgaatcatttaaatagcaggaaaacccgatcatctcaattcctccatcaagaaacgcccgtagaagccgttagtggtttgcgggcaagtgtcgatcaatagcgaaaatctgaaagccctttcgtgaacttagcgtacatgatctttgatgatatttcaacatatttctaaattatttgaaataaagtttcaaaagggagtaaaaaataacgcaccgttggccggtacgtaaaggcatgatcatttgaaaccgtgccgcatgaattctttatacgctgtgactgccgccttggaatcatcggtttgcttcttagcggcatcgtagtaacggctaacgtaagcgtaatataaaatatcaattaacataaactgggcatggagggattgcgtcgcggcaaaacgattgggcgcctccatcggctgtgacgtttgaatcacgatatcggcataatgggtgagggcgttactgccaagtttggtcgtggcgattaccggtaaaccggctttcttagctaatttggcccctaagacagcctcgggtgattcgccggaattggagatgaaccacgtgagcgtatgcttcggatcggcagtggccgcgactggcaggaaaaggtttaaatcatcgctaaagtggcaagcataacccagccggctccatttctgagcgatgttttgtacggatagataagaagcaccaacgccgaatagcaggatttggcgactacggtgaatcaaatcaataatagtttgaaccgtgttttcgttaatctgatcaactgtttcggctaaagagcgggatgcattggttttcaacttggctttgatcgtcgtcaggctttcatttttttgaatttcctgatgatcgatttcaccgacttcgccattcaaatcggcggctaattgcatttttaattcgttatagccgttaaattgcaaacgctgggctgctcgactgacagtggccgggcttgttccggcggctttggccaattcataaacactcatggtcaacacgtcttgcgtatggtttaaaacatagtcgacaattttcttttccgcttccgaaagttctccgcgggtactttggtagttgccttcaacactcatgctagcctccttgaatcatcatcatagtgttgccgatcacttaggccggcaaaccattatggcatgaataaacggtgctgccaatggacgcggcgttaatgaacggttatttttccagcgccaataattggtacggcgatagaaagcgggttttcatcaaaatatcgacaatttctgcttccgagcgcgggttcgtttcatttaaccacaattggataatatcaatgatgccatacacgatgatctgactgacgtaagggtcggggatgtcgtggataaaatgcgcttcacctttcaattcagcgaggtgaccaagaattttatcccgtaaaagtttggcgattcggcctaaaaagcttggatcacctgctggactgagcagaaactggcatagatcacgctgttggttaattaaatgcaccatgttgaccatcaatggagatcgctggccggtagcaagggtgctgggatccatcgaagtgtccatcccgaagtccagacaatcggtgaattcattaagcaacgcggcttcggttttagccaccagatcgtctttatcgagatagtgcaaatagaaagtcccgcgactgattccgcttgctctagtgagatcggcaactgaaacctttgctaacgtttttttacgccctacagcaatcaaagaacgaacgagggcctgtttggtttgcgcagtttgttcggctttcttcatgatctcgctcctttatacaaccgtttaacattcaagttggttttaaagatgattaacacgatgttcatcataaaccattttggtagggaatacaaagattattgagcgacttcattttaagattgcctatatgctggtttatacgtgaatgagtcggtatgtcaacggcctgcgtagaaatgtcactgaacacatctgaaaaaattgcctatagtttcctgagcgtggcgggtttaagctgtttttgtaagatgattaacacgatgttcataattattttttggaggtcatcggcatggcaaaatttatcacggtaaaagatgaaaccagacaatatggctcaggtgaaagtactgtttatgccaatcataatgtttcgtttgaaatcaattcaggtgagatcaccgtcattttaggggcttcaggtgcaggcaaatcaactttgctgaatattctgggcgggatggataaaaccaccagtggtcaggtcacagtggtaggtgagaacatttctcaatatgatgcgcggcagttgacaacatttcggcgagagcaggttgggtttgtcttccaattctacaacctggtaccgaacttaaccgcactggaaaatgttgaactagccagcgaaattgcgccggacgcattagatccgcaaaagacgttggtggacgtcgggttaggcaaaagaatgaataacttcccagctcagctttccggtggggaacaacagcgggtggcgattgcgcgggcgattgccaagaacccgtcactgttattggcggatgagccaaccggggcgctggattataagaccgggaaaagcattttgaaactttttgaagacttttcccaccaaactgataagaacgtcattattgtgacgcataactcgttgattaagcccatggccgatcacgtcattgagatccatgatggcgaggtcaaagatgactatcacaatgatcagcccacaccggtcgaacaattgaaatggtaggtgacacagtttgagcaaaaaaatgctttggaaggatatacgcaaatcctttacaacgtcatggggccgatttttctcgatcttgcttttgatgatgcttgggtcatttgccttggtcgggttatgggttgccggtccggatatgcgagcaacaggcgcaacctattttaaacaatataatttggccgatttaaccgtcattggtgaagatggtttggatagccacgatcaaaagacgattcaggcgacagctggcgcaaagcaggttgaattcggttatcttaaagatgtcacgctcaaaggcacgcatgctagttttcggattatgtcaaaaccggataagatctcaaaatataagcttgcttccggacacatgccgactaagacgaatgaaattgcaatcgatgctaactacaaaggcaaatataagttaggcgacacgattaagtttgtgcaacgagcggatcaaaccggcagcaaggtgcttaagcggacgcaattcaagattgtcgggtttgtctattcgcctgaagtcctgtccgccattaacaaaggcgacagtacttcgggtagcggtgatctcaaaggatacggggtcgtcacagcgaataacttcgatagcgacttttatatgatggcgcggatcacgtatcaaaatacccagaagctggatccgtattccgatcaatataccgatcggattcaaagtcataaaacggctttgaaccaacgattgaaagatgcgcctgcagatcgcttggcggctatcaaaaagcaataccaaaagaagattgatgcgggtcaaaaaaagcttgatgaagctaaggcacagttagactcggctaaggaacagctgacaaccggccagcagcaattagccagtgccaagcagcaaattacggcaaagcaacaggaacttgatacggccgttaaaaatggccaagcacaaattgccagcggggaagcacagttacaacaagcagcgactcaactttcacaaagcgagttgcaactagccagtgccaaacaacaacttgaagccagtcagcaacaactggatgccaaacatcaagatcttgccagtgccaagcaacaattggatactgccaatcagcagcttgctaacagtcaggcgcagttggctgccgctaaacaagaaattgacgcagcgctgacgaataatccgcaaatcgctcaggtgccagtattccagcagaaacaggcgcaatatcaaaatggcatcgcgcagtataaccaaggccttgaacaatatcaaaataatttacaggcctataacaatcaagttgcagcctggaatacggccaataaccagcttcaacaaaagtaccaagaatataattctggcgcgagtcaattccaacaaggccagcaatcctatgcggctaagcaacaagaattagaacaagctaagcagtcattggcgactcagcagcagtcgggacagcaacaaattgaggcagctaagcaagaaatggcctcaaacgaagcaacgctcaaaaccaagcaggctgaatatgatcagcaagcgccaaacgcagaaaaagaaatccaaagtaacagtcttaaacttgaggatgctaaagaagcgctgaaaaatcttaaagcacctacgtacacggttgacactcgtcgtgaaactccaagtgggcaaggctacatggtttatgacaacacttcaaatatcattgattcgctagccaatattttcccatttttcatgtactttgtcgcagcgttggttacttttaccactatgacgcggttcgttgatgaagaacgtatcaattccggtacattggttgcactagggtatagtcggcatgatgtcatcaaaaagtttacagtgtatggtttcctgtccagcttaatcggttcgatattagggatcatcagtggacatatcttactgccattgattgtgtacaatgcctaccatggcggggttaatgttccgccaatcgaattgcatttttatcccggcattagtattgcggcgttgttacttgcgatgatcagtgcggttctgcctgcatggtgggttgcccggcgcgaactgaaagaacggccggctcagctgcttttgccaaaaccgcctgcaaacggctcaaagattctgcttgaacgggtcggctttatctggaagcgtatgagctttacgcataaagtgacggcgcggaacattttccggtataagaagcgcatgtttatgacgatcttcggggttgccggatcagtgaccttgctgttttccggcttagcggttcagcacagtatcggcggggttaatgatcggcagttcaacgacattatcaaatacgatatgatcgtggcacaaaaagacaatatcaccaagaatcaacaaacaagtctggataagctttttaacgaaaaagcggttaagaagacgaaatcagttcattacgaaaccgtcagcaaaaacgctggcgccaatcatgatcggcaagatatcaccatgattgtgccgcagtcaacgaagaattttgacagctacattcatttagcaacgcgcaaaggccaaaacaaactgacccttcaagataatggcggcattatttccgagcggctggcgaaactgttaaatgtcgatgtcggggatacgatcaccgttaaagaagcagatggtacccgtcgcaaagtcaagataaccggcattaccgaaatgtatatgggtcacttcttattcatgaacaaaacagcttaccaaaaagcctttaataccaattacaaggtcaatgggcatttggttaccttaaatgatcggtctatcagtaatacccgggcccatgccgcgcaattcatgaaagaagatggcgttaaaggcgtggttcagaattcttctttgaggaatcaaattacgacagttgtgaaatcgttgaacaagattatgggcgttttgattgtgttggcagctgttctcggcgtcgtgatcttgtataacctgacgaacattaacgttgctgagcggatgagggaactttcaactatcaaggtcctagggttttatgataaggaagtcacactctatatttatcgcgaaacgatcctgctttcgattattgggatttttgtcggctggggttttggtgaactcttgcatgagtatattatcaccgtcgttccgccaaataacgtcatgttcaatcccgccctttcagcgccaactttcattattccaaccatcgtgattaccatcatcaccgttgcacttgggttcttcgtcaattactcgttgaagagagtgaatatgttagaagcactgcaatcagttgattgatgtggcttgaggtctttccccaagcgttctaaaaagaaacaggtggcttaagttggaaaaagaccattgatttcgctatcgcatcggaaacggtgtcgagcagtctcctcgcagtgcctgagttgaggttgctcgattttcgtgatcgtcaatggaaaaagaacagataaactaaaggagacacgaacaacatggatggcacaattgattttcacacacactttttaccgaaaaaatacgcacaggcacttaaaaagcacattcccggtgatccggacggctggccgacgccgggatgggatgaacacctgacacttgggttcatgcgcaagaaccacattagttattcaattctgtcgttgtcttccccgcatttcaattttggggataaggacgaaaccgttgaaattgccagggatgctaatgagaccggttcgcaagtcacacaacggcaccgcgataaattaggttactttgcctctttgccattgccatatctcaatgaaacgcttaaagagatcgacttcgccttagaacatgatgcgctgggcttcaccgtgccaaccaatacgcggggtctttatttcggcacgccgatttttgacccaatttatgcacgccttaatcaaaagaaggcgattgtcctcatgcacccgaaccggccatcgcaaggtccgttgaacgtcaacattgacatgccgacaccgctgatgggtttctttatggataccaccatgacctttatgaaccttatccggtaccacttctttgatcgctatccggatattaaactgatcgtgccgcatgcaggggcctttctcggtattttggcagatcgtgatgctgcctttgtgaagcagcaatacaacgccgatatgtatgcgattttgcgccatgtttatttcgacactgctggcgcggttttcccacgtcagttaccgatgttgctgacactggcggatgagtcccatgtgctatatggcagtgatattccgtacacagctccgatgatcgccgcacaaatgttgaaactgtttgagcctgagacataccgcgccaaaatggcaaaccgaatcaccaaattgaaacactttgatccggttatgacgcattttaaaaagttccgtgcactaccaaccgtgctgaacatgtcgagtaaaatgttgaccggtgcggaaattttgtcaccggaaatggcgcaggatattttggtcaataacgggcaacggctgctcggtaaaatttgaccggattaaagcgtaaaacgccttatgcggtggcgggatcattcgtttcgagccgctgaatttaaaaatataaataatttcgttcggatttttcgcgaatagtggttttatctattattaaagttcgtattttgcttgtcatcaccttgcgatcctgttagactaccaattggcgggcaaaatcccgcactaattcgtgaggagcgattaattaatgggaactgtagttattgtcggcacacaatggggcgacgaaggtaaaggaaagattactgatttcttgagccaaggcgccaaggtggttagccgttatcaaggcggtgacaatgcaggccataccattcatgccaatggtcaagtctataaattacgcttgattccgtctggtgttctttatccgcatcagttatccgtcatcggtaatggcgttgtggtcaaccctaagagcttagtcggtgaactggctcggctcgccgaacaaggggtaactggtgaaaatctacgaatctcagatcgtgcccacgttattttgccttaccacattaaactcgataaattacaagaagaagcaaaaggtgccgataagatcgggacgacgaatcgcggcatcggtccggcctatatggacaaagctgcccgggtcggcattcgaatggcagaccttttggataaggatattttcgcagagcggctgaaggcaaacctgaaagctaagaacgaagaattcgtcaaggtctataacagcacgccaatgacgtttgatgagatttttgaagaatattacaactacggccagcagttgaaacaatatgtctgcgatacctcgattgtgctaaatgacgcgattgatcaaggtgagcatgtgttgtttgaaggcgctcaagggatcatgttggacattgatcaaggaacgtatccatttgtcacctcatcgaacccagctggcggtgtcacggtcggtgctggcgttggggcatccaagattgatcgcgtggtcggcgttgccaaggcatacacgtcgcgagttggcgatggcccattcccgacagaattgcttgataaaaccggcgacttcatccggaatgctgggcatgaatttgggaccgttaccggccggccgcggcgaatcggttggtttgacgcggtggttgtgcgccattcacgccgcgttgccgggattaccgacttgtgtctcaactcaattgatgtgctaaccggtttggacaccgttaagatctgcgtcgcttatgagcgtgacggtgaacggattgaaaattatccggcatcgttgaagttcctgagtgaatgcaaaccggtttacgaagaattgccaggctggaaggaagacattacccatgccaagacactagccgatttgccagaaaacgcacggcattatgttgagcgcatcaccgagctgctcggagtggatcttttgaccttctctgttggcccggatcgtgatcaaaccaacgtgattgcgaacgtgtgggataaagtgaagtaaccgatttgattaactaaaattttaaaaaagctgtcagtgcgagttttctcgtactggtggctttttttgctgtgcgcgagccgccgcggttagaagtcggagtgtaagcggccttgggcgtgatggccgggctttggccattgctcctgaggtccttacacgcagtcttctgcgacggggagcgcgttatcgaaagtgagcgtaaatactttgtcacatttaaaaaagcatttttaattgacttccggacccaaacccggtatattcaagttgttatatgaacacatgctcatatgaacattaaatataagggcgggattattgatgataacaaacaaaccaattggcttttatttgttaggtgtggctgcttttatcggcggcttattcatcacccaaccgttggcacgcgcagggctcttgattgctgctgcagtcgctgccgggtatcacgtaattgcagaaggcgtgattgagacgattcgggattccaaaaagcaacatcgatttgcgccgaacattcatattctcatggcattggcagcagtcggggcgattgcgattggcagttatgaagaagcggccatgttgattctgatttttgctggcgcggactttctcgaagactatgtcgagaataagagtcgcaaagagattaccgcacttttggcaatggcaccacttgaggcccgacgctatgggcatgatggcgagtttgaagtagtgcctgttgccgcattgcacatcggtgaccgcctgcagattctcaatggggcgcaggtgccgacagatggcgtgattattgccgggactgccagccttgacgagtcggcgatcagcggggagagtatcccacgggaaaagcaagtcggagatgaagttttcggtgggacgcttaacggccagtcaacctttgatatgcgggtgaccaaggccagtgacgaaacggtttttgccaagatcattcaaatggttcaaacagcacaagcgacaccgactaaaatggccagtgtgattcagcgctttgaaccactttacgttaaagtcgtcttggcagcattacctctggtgtttctggcaggaccgttattgctccattggtcgtggatgacgagcgtgtatcgcaccatcgtttttctggtggcggtttcgccttgtgccttggcagccagtgccgtacctgcaaccttggcggggatttcgaatctggcgcggcatggcgtgcttttcaaaggcggacggtacttggcaaacctgacgcaattaaaggcgattgcgtttgataaaaccggcaccctgacaaaggggacgccaactgtgactgatagtgaatttgctgccgatgttgatcaagcagcggtgatggcagttgtcacggcgatggaaaagcaaagtaaccatccgttagccaatgcgatcgtggctcattatccggcgactgatgtggtgatcgacaccgttcacaacgaaatcggcaaagggttaactgccgattatcaaggccatacctatacagtgggtaaaccgcaacgttttacgcatgcgcctgcgcttttccggcagcgcgccatggcgttggggcagcaagggaaaaccgtgatttttgtggcagtcgatcaaacggtggtgggcctaatcgcgttgatggatgaagccaaaagcagtgctaaagcggccatggcttacttgaaacatcatgatattcaaccggttatgattaccggcgatgcgaaacaaaccggtgaggctgttgccgccgatttaggcatcaaacaggttgtgaccaacgtgctgccagatcaaaaagtagcggtggttaagcaattgcaggaaacaatgcggccaatagcgatggtgggtgacggtgttaatgatgcgccggctctggcaaacgcagaagtcggcattgcgatgggttcaggaaccgatgtcgccattgacgttgccgatgtggtgttgatcaaaaacgatctctcccggctcgcatttgcccatcaggtttcaaccaaaatgaaccgtattgtcgttgaaaatcttgtcttttcgatggcggtggtgttgctcttagtcacgctaaatgtactgcagttaaccaacattgcctggggcgtctttcttcatgaaggcagcacgctcatggtgattctcaacggtttgcggcttttgctaacggaagaaggaacacattcacaaacaccgcatgtgcaaccacagctagggtaacgggttcggctcggtgaatcgttgcataacaaactgcgcttttaataccaaagtctgctaaaatgaggcttaagtatcataaggagcgcattgcgatgacaacgaatgatgttcatgcggcagctgccaataacagtgaaattccggatgacgccgatttacgagatgttcttgatgtattcaaaaccatgagcgatcccacgcgaatgcgaattattctcgctattgcacaaggacccattaccgttaacgatcttgcagccatgctggatcttggccagtcgacagtttcgcatcagttacggttattaaagcaggctcgattagtcgccggtgagcgatccggcaagcagatttattatcatttagtcgatgaccatgtgttggagatttatgcgttgaccaaggcgcatattgaggaaaagcagcataggcagtgatgaagtacaataacaggcggcgccaacatgcagcctgacattatcttttgtaaaggcaagtgtttttccggctatcaggaaggcacttgtctttttgcgtttattgccgtttatcctaacagaagaaacggctgcgtctaaaagctgatatttacattattagaagtaaatgataccatcattaaatccctgcgctcaggcagtttgctaaatggtagcactcatgacggctaatacgtccgacttaagcattggcgagccagcgtctcttttcatttgtagactaaggatttgaccgagcgaaatttaaaatgaaagcgttcgaaacttaaaggtgttatggaggtgttatatgtttgggcggcccataagtaatagatataagtactattggtatacagtcttcacgcaacttagatttaccagaatcatcaatatcatctttgttgtccaatttctaaaattcaatttagtacaattcggacttttgcagtcggtatttttgttatcgcagtttgcatcggaattgccaagtggtgttttaggcgatctttttcgaaaaaaagcggttattatttggggcttggttttactgacgatttcgcccatggtcatgatttcggccagtttggtaggcaacgattttatgtttacgaccttgttaggtgcttttttattggaaggcgtgggtaacgcgttgcttagtggggcggatgaggcgcttttctttgaagcaattcgcagagacggtcgggccaaacagtatgcaaagattcgtggtgaggcacagtttatcggggccattgttgtaggcgcggcaacttttttaggcggcgttttatatgcaatcaatcgcgtgttaccgtatttttttcagtcgttaatggtggcagttgcgggtctggttatcttttctgtgcgggaggataaacgcgtcactgcaacaattgaaaaagttaaggaacctagtcaagttaagaatatcctcaccgtttttgcggaaattaaagcatcgaccaatgttctgttcttatttatctttacggctttgatgtctgcaatggtaaatgccatttttgcgatgttgccagcgtatttttccaaactcggcttttcttcttctgcaaatggactgatatttatgctctttagttttgtgggcggattggtggcagctcaggcttatcggcttaccaaggtcagttctaaaacattggcgcttatcgtagccggtattttagggctgggggtgatccttcagatgcaagcaagtatttatttcttctctgcaggtgtttgcttgttgtacataacagtggatattctagatccgattgttctggaaatgttgaatctgtgggtgaaagactctgcgcgggcaactttaatctcgggcctttcatttgctactagtttggtgacgatgctgctcaatccgttaatcggtatgttgattcaagtatatggaacaattccgatgttagtgatggtttcaatgttcgcgattgtcatgatcctttttttcgttcattttagtctgaaatcaaaaccgcaagaaagcgaataaagtaatggaaggtaagcgcgcagattgatgtggacgattctgaacaccgatcaaggtcttgaatctaaaacgactttaaaacggacaagctgcttagtgagaaagtattttctcggtaagcagctatttttatggctaaggaatgaatggctaacatgcgcggaggttataactcgctgctgaaatgacgttattttaaaaataaatcgcaagcaatcaaatgatgtaaaaccactatatagtgtatgcttattttaacaaaccacaaaatttggtggatatcccgttacttttgcttctgaatcttgtatactaaatacattgttacaagttttgcaagtaagggtacgggaggactagccatgatcgaattttatacacaaatcaagaaacgggatgggcggatcgttgattttgatgcgaccaagatcagcaccgcgataaccaaagcggcagaaagtgtggcgaaactgtcaccgcgcgatgtgttaaccattgaccacttgacggatacggttacggctaagattcgcgatcggtatcatgatgatgttgagattgccgaaattcaaacggttgtcgagcagacactcattgccgccgaaaagtacgactgggcagaagcctacacgcaatatcggctgaagcgtgatttagcgcgcaaacagaagcaagacgttaattacaatgttgcgcggctggtcaatcgcgataaaagtgtcgtcaacgagaatgccaacaaggatagtcgggtgttctcgacccaacgtgatttaacagccggtgcggtggccaaagcgattggcttgaaaatgttgccgccagccgttgccaatgcgcatttgcgtggcgacattcattggcatgatcttgactataccccgttcatggcggaaaccaattgctgcctgattgattttgactatatgttgaatcacggcttctccattgggaacgccgaggttgagccggcccactcgattcaggtggcggtgacccagatgacgcaaattatcgctaacgtggcctccagtcaatatggtggctgttccagtgaccggacagatcaggtactggcgccgtttgccgagaaaaattaccagaagcatttgcgtgaattcggtgatgtgattgatgatcccgctaccctcaaagcgttggcggtgaagcagaccaagaaggatatttatgatgccttgcaaacgctggaatatcaggttaacaccctttattcaacgcaaggacagaccccgtttgtgaccgtgggctttggtcttggcactagctggattgaacgtgaaattcaaaaggatattttgaaaatccggattctgggtctgggcaaggaacgccggacagcgattttcccgaaacttgtcttcacgttaaaacgcggcctgaaccttaatccggatgacccaaactacgacatcaaacagttggcgattgagtgcgccaccaagcggatgtatcctgatgtggtttcctatgacacaatcaagcggctgactggctccttcaaagcgccgatgggttgtcgcagtttcttgcaaggctggaccgatccgaagacaggtaaggaagtcaatgccggccgcatgaatctcggcgttattacggttaacctgccgcggattgctatggagtccaaaggcgataaagataagttttggaagatttttgaagaacggatgcgcatctgcaaggaaggtttgctttacaagattgaacgaaccaaacaagccacgccggaaagtgccccgattctttataaatatggtgcatttggccaccgtttagccgataccgatagtattgacgatcttttcaaaaatggtcgtgccactgtatcgctcggctacatcggtctatatgaagtcggaacggtcttttatggttcagcatgggagaagaatcatgacgccaaggccttttccgtttcgattgtgaaggcgctggacgatcattgcaaggcctgggagaaacaatacggctatcacttctcggtttacggcaccccaagcgaatcgctgactgacaccttctgccgcgaagacactaagaagttcggcatcgtcaaggacatcaccgacaaggaatactacaccaacagtttccactatgacgtccgcaagtcacccacaccatttgaaaagctcgactttgaaaaggactatccgcaatacagtgccggtggcttcatccactattgcgaatacccgaacctgaagcaaaatcctaaggcactggaagcggtgtgggactatgcatacgataaaatcggttatcttggcaccaacacgccgattgatcaatgcttcaaatgcggtttcaaaggtgagttcacagcgaccgccaagggatatgaatgcccggaatgcggcaaccacgatccggctacctgcgatgtcgtcaagcggctttgcggctaccttggcaatcccaacaagcggccaatggttcacggacggcaagaagaaatcattcaccgcaagaaacatattacgttcagcctgaatcaggtggccaatcgccgcgataagtagggttgatcaaagtggcatggaaaaagataataggagcgatcgtctggagatcagacggtcgtttttgttttctagagactgaatataaatagtaatcggagacttttcattccgcccattcgcgtgtagaatccaaggcaagttcttgctgacggttggaatagcgtgattggaggtgtgccatgatagctggtgtatttactgctaaacaatggcaaatagcagaacaatggaataatgggtggctgattgttgcgattattgtcattttattcattatcttctgcctcctactcgtttctttttatgtacccaatccctggaagtggcggattttcgtacctgccatccttatttgcatgagtttgacggtttacagctggttgcgaacggacaatacggctaattaccaatttaatcaatgggccgcaaaaatcacaccgcagatccgcactaagaaagcggctctatttacttatgtctccgtcccagaaagtgaagttaaagggtatcgggcattaaatgattacccggcgcttacaagcttacccatgtatacgcgtcaccgagtcatagcatcagtggtctatcttgggcgtgatgacaatgcgcgctactttaagttagacggcttagtttatcgttattccggaccaatacagatcggcgaacaggcggctttaagcggttatcgttttcggttaaaggatcgtggctatactcaaatgggattcataaatccatccaagaattttacagccgctctagtgatcccgcgaaatcagattgagcagcattaccatccgtctaaggaggtcgtcgtgacactcgagaagatggatggtgaatggacgacggaaaaggtctatcgaaagtgaaaaagtttgtgcagtcattttgcaggctgacggtgtgggcagatgggttttgttaggataagcgagcctgcgccggcgatgaggacgagaactaattgcagatccatgccttatgaactatataaggacaagacctgtaagcaaatatagtagcccaagcgcagaaagggtcaaaactatgaaactaaaccagctagcaaaaatatgcgctaacttgctaggtatataaagcggggacttgacgctaagacagatagtcttgtaatacttgacggtaacaaatgcatcattttgggagaaaacgtcctaattggcgattaagcccttaactccccacaaaaaatagccgttacctgttcggaaacggctatgaaaatcaccggttgcttttactttggataaaggaattggctgtacaaggctcggacataacataataagagacttttttaacctatatagcctaactgcatgaatgctgtgtaccgccggaatcatcagagctgcatgtatgtggaatattatttaaattcatttatagttttatatctccacacaaaaagtgttgggggctctctaagaaaccggaacaaaaaacatttgattttctgtaaatttcaagcgcgttcttaagatttattggattatttcaaatagcagtacaccaattcaatctaggttattttttaggaatgcaagtacgttcttcttatccgttttcatgcttcctgccaagaatgcaactatgatggcaataacagagagcacgaattctaataatgaccacttgaaaattaacgttaagactaacggtacaaggactgcaattaacaagacgccatctctgggacctaaattaatataaggatacatcatcattgagtatcacttctttcgttgtctagctaggataatactagttgaaccatatcttcaaatgctattttgttctccttcaataatcgggagagttcttgggcgaacaagttagctttacgaaagtctacattttggtggttaaacatcagttggaggcggaattgtatccggataaggattgaattgtgtctcggaaacagggacaagaggacagatcccttcagatatcgtcactaagctggcgaatgatggtgattgtctatagttcaataccatcatggtcatctccttgtagctttgcgaacggaatgtttgaaaaaatgacccttatagatgagaaaagattgacgaaacagatggtaaacgcttactggactatctaactaaagtactacgcccttatcttttctctgtcaagttggatatggatacgaatgaaaaagttgatacttactcaaaataaggacggtttttatcaagcatatgctgtgataagctaagaacatcaaaaattctgcgaaaggcagtgatgtaaatgatcctgttaggtaacctatgccgaatggttacacttgttttcgtccttattagcagcattctcattagcaagccaaaaatgacgcggattcgttttataaaactagcaacactagcaattaccgccgctgttttcttcgcactgagtctgtggctggagaaagaagcctctggtgccgtttcatcgttagtagggatggtgatggttgttattgtggcacttgaactgggatacatacgcaagcgcaagatggtcacgcgttgagaagtactcgcacatgcttattttgcatgctgacgatgtggccagacgggttttgttaggatgagcaaacctgcgccaccgatgagaaccaagactatttgtacatcaattccccgaaaccagataagatataacgctgttaggcaaaagatcaagcccattaaagaaaaaaaggtggctatgagtaaacggcttgtaatagaccaacttgcaaaaatatctgttgattttggatcagaggcccgactccaaattaacaaaacgatggcataaattgaccagataacctgcgcaagccaatgagggaaaaagcccaagaatgttgtcgctgccactccagtcatgattagactagccgtcatcaaaacagccataacaagctgatgccggctcactttactatccttaatcaatttttcgtttaactcagaatcgtcgaggatcagggtatcaagcgacaccgaaaagatccgggcaatttgagtcactgtttctaagtccggtaaattgcgttcattttcccagttagataccgtgtgccgcgaaacgtgtaattgttgtgccaagtcagcttgcgtcatgctgtgtgcggtccgaatctgctgaagctgttttgaaaagttcaagatgatcacctcgcttggtttgattgtggcagaggaggtcagaaacagcaagaaagagagaagatccgcagcgcgcgttattcgagacaagactattacccgggaaattttgcattcggtggctggtgaaaaccgattaccaaagcaaaaacttaaaataaatgtcaatttgtcagcattcgcagtgttagcagaagatgctcctgcactaatcgccataatgtttgacaagtaaatcatcatgcttgtgatcaacgcacatttcatgctatactccattcggtgccaaaccacggtgagttcgtaacgatcggcgcgtatgcgttcagaaggtcgaagcggctcgccatttttttatgagcgcgagccggcgcggttagaagtcggagtgtaagtggcctcaggcgtgatggccgggctttggcaattgcgcctgaggtccttacccgcagacttctgcgccggggagcgcgttatagataatatgaagtgaccccctagattgtcgactcggggatttagactgataatggtgttgtgttaaaacgagccatacaatcattaccccatgacaataggaggtcactcacatggaaagtatagtttacgtcgggatggatgtccataaagccacttacagccgacggcgtcaactttttgtgggtttaacttgtaaactttttgctagaatgctttttcaacttacaactgatgtgtgataccgtattgccagccgcgatgtttcccactagcgagttctacaaacgctgcttgcgccgcttgtgagtatttcgtggctgctgatttaaactgaatcttaatacgatcatcaacgcgaatatcaatctttgtttggtgacgttccttggcttcggcttctaaccgctcaaaaacgtttccgcccttaagcacgtatacccgcgtctgtgataaattgtctgtgccagtttgtgaccagcccattggccgcgaactgaagcgctctgaaagcatatgactaatatgaccttcagctgatgtcccgtgaaagtctggatcattgttggcctgaatttgtttccaattcttgtgaatgagcgttcgtgcttgtcggacagctttgcgttctgacgaccgtaactgagggtcattgagccgaacacggaaataatcatttagatagcttgagtgcccttgtaacgcccaatgcatgagaatatcgcccagattaccgggtacgccaattgccgcttgtttgcacgctttacgtaggtgaaatttatcgtagaccaccgtgcagttgggtagaaaatcggccccggttttgatccaactggcaccatcaccggccagaaaaaagcgtttgggcatctgaccgccatattgtttcatgatgcaatcaagcgtggtttgccagatttcttcagtaccagctgttcccgggtattcaccggtaatataaaatggcctaatcaactgaaacttcttacccacagaccgataaccttcatgtacataaaccattttcaagaaatgattggtgccgtcctgatgggggacatgatcttcatcggcttcgacaaataatgtttccggtacgggcattggttgatcctttaactgatccaaagcgctgatggccttcccgtctctatgaacaacatgcatgacggtgctcttcgatggttttgtacccccgccgttacgatctcctgattgcttgtaagacatttgggcggcatcttccagcagcttagctttgaggtcgagcgaaagtcggctacgcttctcaataccaacgagttcatcaagcaagaagacacgctcgccagtccgtttatcttgataataacgtcgggtgaaaaccagtgagccaatggatgccaagtaagtgcgttcccgcttatctttgacgctatagaatcgacggcggtaagcactgtccataatagcttggtccacttgttccagtgcctgcccaactaactggcagaggtgctcacgaaagttttcctgattggttaaaatgaattgacttaaatccagcttgcccgcgaccatctccatgacagattcatcaatttctttcaacatttctaaaatgatttgttgtactataggtgacaagagcgaattcctcctactgctatcgtgtttttcttgcaattaacattctagcacgaagggattcgctccctttttgtttgctcagatatcacccacttaaactttacgccatgcttacagcctatgcgcgttagacaaagcaacgggtgcgctcttagctgagacccagtgcgcttcagagccaaaattagtcgaaaaatttattaacggattagctgaagaactggatccagacacaaaattcgtgaccgggtatgaggctggtattttaggatattcactctatcgttcactcaaaaacttaggcattgactgtatcattctggcaccgacaacgatgtatagttccgctaagaacaaaatggtcaaaaatgattcaatggacgcgcgaatgatcgccaagaatcttgcagctaatacgtattgtgccgtttatgtccctgatgaagcggataacgaggtgaaagaattcattagactacgtaaaatgatgaaaaaggacctcattagagtgaaacagcaaatcggcatgttccttctccgtcaaggattgaagtgctcagcatccaagtggacgctggcctatatggattggctaaagaaagtcccattgtctccggtattacggtcagtgcttgacgaaatgacgctgcagaaatctgaattagaggaaaagattgcccgctacgaccagaccatcgagacgtttgcgaacagtgaacgttacaccaagcccattcacgcgttgacaagtatgaagggatttaaaaccacaacagccatgaccatccacatcgagattgcggacttcaaacgtttcaaaacagctaaagcgtttatgtcttacgttgggctaaatccgtcagaacattcaagcggcgatcataccatcaaaggggggatttcgaagcaaggtaacagtatcgtccgcacaaccatcattgaagccacacagggattggtcaagggcagcattgggtacaaatcaagagccctaaaagcacgccaagcaggacaagaatcagccgttattagctatgccgataaggcaggcgctcatcttcatcgcaaattcacgcggatgcttactcaaggaaaatcatataacgtggcaatcgccgcagtcgcccgagaactcgctggatttatctggggtatggaaactggcaatatcaactactgatcaccaaagcgcaattgagcccgaagattcaaacaacaaagatgacagcaagaagtatcaaggactaaagcgtcacgatattgtcgctggtagcaacaagcgtcagaattcaacggtctggctatttacgagcgttctattttggcacaggctcgccctgggtatggccatatctagagacaaagagtttgtgatccacgactatagattagattctaaagccttcgacgggaccattaacctggggtagccaatccccgtataacagagtggttaaatgtcgagagacaacggaattctggagcttgttagtgccaacgacaatatcgaaaatcttataaagatggggttgacaggggtcacttcataacagaacgcacaagtaaacaaacaaagcccccaaaatagaacgcattccagtctccacccacaatgtcacaacaccaaaaaaccgcagccatttcaaaaacggctgcggttaaacatatcactaagtttcacccaccgacgctgataaagtaaacttcaagcggccggctctgtatcaagcttctttgatttcgaacgcatcgtcaacgcttcccagtcaaccaatggcaattgcgccaccgcacccagaatcaaaatcattgaccaggtgagaatcagactcatggtcacatcaccggtgaaatgcgcgagaatccggacccgcgtataagccatcaaagcgccgtaagcgaaagtgagccagaagactaaccgttgacgcttcggctggtcacgatcaacgaaccaagtcaacgtgaggatggtcgccgcggtttgggtatggccggacggaaaactcatgtgaccgttagcaccatttggctggaaccagctggtgaagtgtgccggattaccatttaattcgtaagggcggaaacgaccccagaaggttttcatgacgttcacaatttggtcggacatgatgcaaaccaaagtggcaactaccgccacttttaataagtaatggagctgttcatcgcttttacgtgaaagccagtattgactgccagcaaacacagcaacgtagagcactaggaacaagatgacgcttagcccacccggaagagccagcttgctgccatcggaattggccattcccattggcttgccggcgttgatgtcgttgattgaagtgatcaccatcgtcatcgcgtatttcagataaccagcccacagttcccagccggcatagatgacactaccgatcaccatcaagccgcgaatgtaccatgcgagttgcgatgatcgcagcgcatagtgacaaacaacattacaactcaacataataatcagtggcgcagtccagaggccaacgtcttgaaaaagggtggcaaacggatcgttcatgttaccgatcgtttgagaaatctgccaatcaaagccagcagctgcagccaacaataaaagtaagataccagcaacaatcagaaaaatatgtttgcggatcggagcgtttaatttttgcgtttggtccatatcttttccctcccatgtactttgaaaatagcacatagtttacagaaaatggccggatttacggtacctgtacgtaacatttaagctgccgatacgaaatttacagagggttgctaaagtaaggctcgtcaacggttagctggcggcgatcaaagttgatggttgcctgtaaaccatatggtaaaacggtgcggggataagcgtggccaaagtttaagttgtagagaatgggcgtttgataaggttgcgtgacatccaagagcacctgctgataatctgcaaaataggtttcgttttgaggcttacccactaagatggccttcacttgttgcaagacaccgtgatcagccagatgctccaagtactcacgataggtggcaggtgaaattttatcttctgaagtctcgatgaagagaatcttatcagtccaatcttgcgggaaaagatgatactttttagcaacttgcggctcatcgtcgtaacgcaccgggtagagcaagtcgtgaaggctatccaaacagccgcctagcaatgttccggtaacctgaccatgcccacgcagcgctaaatagccatgctgctccggatgcgctttccgcggcacccctaactgatccgcggaaaagtcagtccgctcttcgtaccaggtaggactggaagtgatggcagtcgttgccggattttcgaaaaagtgttggaagctggcagcagtatatggcaataagtgcgtatccagctcagccaagtcgttcaagaagttcggtccgtaaaaagtggtcatgcctagctgataaaacatgagatggttaatggtggtgtcggaaaagccggtaaaaattttaggctgggtttgaacagtcttaataaatgccggatcgtcaagtaggtaaggaacaatgcggtaagtatcatcgccaccgatggcacaaatgatgcccttaatgtcgggatcggtcatcgctgtttttaagtccgcggctctggcttccggatgtacgtttaaataatcacgtccgcgtaaagcatttggcataaaccgaggtgtcagccccatatcctccaaacgcttaatgccaagttttcgttgatgggcagcaaacgcctcaccaagtgtgccggcactgaggctaacaatagcaacttgatcatgcggttttaaagtctgtggttttttcaagggtatccctactttctagtgtgaaaaattaattttcgtggatagctttctttttagtgtatcgtttaaactaacctttgtcttgtatcattttttgaaagtctgcctcgcttttgattgatgccgacattcaaactgtgaaccagttgcttgtcttctaagccggcaagctggtacgatcgaatagaggattgaatgaactgactttaaaaagtaaaatgaccatttttgccaggatttaatggaggattgagccatgtacaccattcaaactgctgcaaccattgccggccgcggtactgtaattacgattgctccgccgattgagcgcattcaagccggtgatcccgttcggctgaatggcgcaacagtcggcaaggtgtgtgcgctggaaaaggcccgccatccgcatcatagtaacaatcagccgtgcctgagcctactgattacggaaccggtggaggtcggcgataccattgagttccctaagtcacaatgttggcattaggcatcatatttcttttatgtgggtaacggatcttcgtgccatcaccgccctgaccacacacctacatagaaaaagcgttgcaattgtcagatgagagctgacagtcgcaacgcttttcgtttacttgttctagtgattggctgtggtcataatgccggcttcagtcatgccttctgcgtaaagtttcagtttaccgttgataatgtccataacgagatcgccatattctacgccatctgcttcggcttcctgtggtaggagcgaaagtggtgtcatgccgggcaggttgttggcttcgatcacccagacacccttatcgttggcaaagaagtcaatccgcccgtagttttgcaatcccaaaacgtccatggtttgtaacgagacatccttcattgcttgatgaaccgattcatccagattcttaggtggcgtgatgaagtcggtgtagcctgcttggaatttgtgcttgaagtcgtaccaaccggaatgcactttaatctcaatggcagaaaacgcccggccattgacaacgcctaaagaaaattcgcggccaggggtgaattcttcaacaatcgcactgttatcgaaccggaaaacatctgcaatgccattttccaattcttcttgattgtgtgcaatgtgcgtaccaacgctagagccgcctgatgtaggcttaacgacaaccggaaagtcaaacggtaccgtatgcttaccattttgattgcgcttgaattctttgaacgccgctgtctggatgccgtggtataacataacttctttactgaagactttattcatggtaatgccggaagccagcggaccggaaccggtatatttgacgttgttcagatctaatgttgcctgaaccttaccattttcgccatcaccaccatgcagtgccaagaacacaatatctgcagccttgcagatcgccaaaacgttaggaccaaacagttgcgtgctgccgtctatccgtaacttgttgatgtcggcgtcagtcagaatcgcatctgaaattttcagatccttactggtgttggcatcatcaaacacttggtcaaccgtttttccctcaaggtcgtagccaagaaacaggtcaatgaaggtggcctgttgccccttttgtcgcaaggcgttcgtgatccggtagccgctggaaatcgacacattgcgttccgtgctccggccgcctgctaaaacgacaattttcatgtgatagtacctccgcgtattatccgagtttgatagaaactaaagtgtagcacaatcaaggcgcaaccgctatcaggacgcgttgaattgtagcaaaaattaacatccgtgcttaatacggttaggcgctgatacttaccaaatttgagcgagtcgagccagctgccatccaaagtttcaaattaacatcatagcaacatttcattagcaacttataaacaatcgcttggcatatttagtaataatcaatgagaaatggaggtgaacgactatcgccactggattgaatatgatgatcgggattgtaggggggattgttgtcgcaatactcgctaatcgcattaacaggccagcgacgaaaacccgcggcatcgtcacgaacacgcttggcatcacttttggcgctttaggtgctcaggctgctgatcagttgctgcatgaaggtccgcagttgtttggtagccaaattgtaccggcaattgttggtggtattgtgcttgcgtttgttgttatttatgcaggcaagaaatggtttcgtctaggttccaccaattaagggagacattcagaatgaagcaaagaagacgcgtggtcacgatgctgttgacgggactttttaccataatagccgccgtgatcttcgaagctggcatgtgggtttcaatgtattggtgtatgaagttgttctaaatacttaataatcccggcagatcgttgggtagttgtcgccgtttgagatagaaagaggtttttgttgtgaaaaaaagagcgaatggtcttcagtctaaacacattgttggtgggctagttgcgttaggtagtctgcttgtagcaatcctatttcctgctttcaagagataaactgcaaccctgaaccaaacaaataaccaaactaaaacaggtattggcgatgcattgcgcaaccgtcaatacctgtttatttgtatgctttacggttaagtgatacccagcatgattgtgataatcaatcatgcgtttgatcagtgaatctgatactgatcaatgctcccaaaccgatcaaaaccagtaagctgccaacgcccattccgaaaatgccggttacctgattcgccatttcctgttgagctgacaacagcgcatattgtgtcaagacaatggccatggcgccatctgccagattaaatgtttttaggaaaaataaggcgccatggtgaagccgccggactcgtaagaagccgatgattgccatggtaagcttgtaaaagccaatggttgcaactgtaatggcggttattttaccaaaccgtgcctgatagccatcgtgatacatgatgaatgcacagatcgtaaaggccagtcctaaaacaacataagcgaggccagcggtttgaacaaataccttggtttcaggtagctcatcatattgacgagatcgcgaatagtggtgtagaaaacttgagcgagcaagcgataagatgaggtaatagccgccaaacaataatagccataaagaaccggtgaccagacccaatcccaacttgacgagtgcaagaataaaattaatacccgcagccaaagttcccatgagagcggttcgatccgccggggtactggcatgacgatgaaacaaccggcgtaatcgctgcatggtaaccctccaattaactaatgtttttggtcttcagcgacaaccacttctggcgttttcgaagatttaacactttttagaatgatgatcagcatcaagacgacgatgatcgacatactaataaaagtagcattcacgccaccaaccgatgccaccacagtttgctgtgctgcaccgcgattggcgataaatgacattaaggctacgctaaccgatgtcccgactgctccagcaacggttcgtaaggtggtcaaaacggcagatgccgaggcaatagctttgccggttagctgggtgacactccaggtgaccagtggcatcattaagcaggataagccgatacttcgcatggcccatacaacagtcagatagatgattgaagttgaagtcgtcaaaaagctggtgccgagactgctaattaggactagcaggacgccgataattgcaagcgggcggatgccgtaacggtcgtataatcggccggtgatcgggctcataattgccatggcaagcgaaccgggcatcatgatcaggccagacatggtggcggagaggtgatggacggtttgtgcgtagatcgggaaaacggtggaaaccgccatgagaacggcatacattaacgcgcttagaattactgcagtccggaagaccggatctttaaagacgtgtaaatcaagtaatagttgatcaacatgcaaggcgcgatagataaatgccatcccggccacaactgctaacgctagcggcgcggcaattgccaaactcagaaacggtgcggtaccaagattaccgaagccaacggtaataccagtaaaggcgatactgatgagcaagaaagactgccagtcaaattgcagcttttcggtcggcaagacatctttgataacaattaaagcaaaaataatatccgctacggcaacgatgacgccgacccagaatatgacccgccagctcatgtaatcgattaagaggccggtaatcgtcggcgcaataatcggggcggcactggcagccaagccgtaaatgcccataatgccacctcgtttcgaaacggggaaaatagttaaaatgacgacttgcgttaacgacagcaggataccggttccgagtgattgaataatccggcctaccaataaaatggcaaaagttggtgcaagtgcagccagcagtgaaccgccagcaaacaagagcatgctggcgatgaacaaggccttggtcggaattcttttgatcagaaatgccgttgcaggaatcataatccccatggccaaggaaaagccgctggtgagccactggccggcgttagcagttacgccgaaagtcttgatgatatcgggtaatgcggttgtcagcgcagtttgcagtaaagacgaaatcagggtacctgtcaataatacagcaaaaatcaaatttcggttcttagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcacactgtctaccgctattacgatatgtggcgagataaaccagacccgacagctgattcgctattagaaaggcttttaaaaaaactgtcgcttcctatcgttttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaacggtttaccacaagccattctcgtgacacgagctaatgtatcagatcgttcaggtgcattggctatgcttagtttggctagccaaaatttagagctggttcagcatgtcatggttgatggtggctacactggcaatgactttgcggatcaggtgaagctcattttgaatgctaagacgacggtagctaaacgcaacgagttgcatacgttcacggtgttaccgcaacgatggatcattgaacgttcatggagttggctagacaaatgtcggcgactttggaaaaactgtgaacgtgcccttaacagcagtcttcaaatggttgtattggccttcctgaagatagttcttaaaagatactagacaggttcttaggtgcagattgtttcattctttttagcctctaatctgaatattagtgtgacgatcaaaaaggaatctggagggcgcattattagttcagcagtaaaaaagcggccttgcttgtctcggcaatggcatcaagttgttgatcaatcagaggatcaattcttgccgaacggcgggcctgccaccagcggtaagcaaaataggcacttccccaggcaagaaaaccgggaatagctaacataaccgatagcaaaatcaatgcggcctcccaggcaaaaaccgagccagccatgaatactgtgccaacgatgccgatcaacaggctcagtgaggttgcacttgattgtttcgatttttccaagcgcacaacatgagccatttgttgttcaaattgcttctgtagccgattaagttcgcttttatgggtaatggagcgatcgcgcttgaacgctaaagtgacaccgtgcagtccttcttttgactcctgtaattgccagccgaagtttgcataaccgtctacataggtggcttgcatactgggagaaaccgtctgggtcaaatattcataggcgataaaactgtttttttgcataaagagaaaccctccatatcttgttataggcgtttgccaagctgatttcgggtggctaacgactgctcatggtttaagcatacggagggcgtgtttttgaattattcatgaaatgttgctgaattgttaattttcactttgcggaagagatacggtgaaggtagtaccttggtgagggttactttggacactgatttttgcattaagcaagcgaataacctgcgccacaatggcgagcccaaggccatttcctgcacttgcatgtgatgtatcgccttggtaaaacttatcgaaaatatgtgcctgcgtattttcgtcaattccctgaccatcgtcgtgaatatggacacgtagcgtggtatcgtcagcttttgcgcgaatcgacaggtgaccatgtggcggtgcgaatttaattgcattgccgattagattgtgccaaacgatctcgaggagttggggattactgataattggcagtgagtcgggtaaatcaattgttagatgtaactgtttagcatcaatcgcattggcatcatccagtaagcagcgcgtcagttgcgcactgagatcgaatttttggtaatcaggtgccgtgacttgggtttgtagtttgttaagctttagaatattcgtgacaagcgttgctaaatgggcgaccgaatcactaatggtggtcaaataaagttgctgtgttttccggtcaagccctgactgttgtaatgcttgggcataaccttgaatatttgccaacggtcgtttgaactcatgtgacacattggcaacaaagtcactacgtagggtttcggtggagcccagttcggcgaccataatattgaagttagcaaacatcgcgtctaggtagtcgtaattctggggtgcatgaaccggttgtaaataaacatcaaagttaccatttgctacttgttcagcggcatcgctcaaagctttaagtggcttgtcaaaagcgcggtatttctgccaggcggtgaatgcggagaagccggcagcgaccaatgcccagtaaagcagataccagcctaataacggcgtcaacactagatgccaattattaccataaagtattcccggtaaggctgctagaatgctcaaggtaaagaaggagccaaagaattgaaaccatgaaaagtgttgctttacttgtggttgaacggcttgctcatttactgatttcataaggttaacaccgccttgtaacctaatccatgaatggtcttgatcgtaaagccatctgctgctttgaatttctcgcgtagttttgtaatgtatacatctaccgcgcgcatgctggtatcactggcaaggtcccagaactcgttgataagttcagctcgggaaaaagcgtgatcaggatatgaaagcaatttataaaggatctggaattcccgaactgtgacatcaaccgtttgatgattgacttgtgcagtaatcgcctcgttgttgagagtgagattgccaacgatcaacaagttgtcggccgtaatttttgcgcggcgtaacaaagctttgattcgtaatagcaattcattgaagtttatcggcttaaccatataatcatcaatgccgctattaaaacccttttctttggacgcaatatcatctcgcgccgttatgaagaggatggggatgcttggatcggttcggcgcagttcttgtgcaaattgataaccgtctacctgaggcatcatgatgtctgataagacgagatcgaattgttcggattgcagtaaatcataggctgccggtggattttcggcaccttgaacagtgtaaccattctgccgtaagatggttgcaatcaggtcgttaaagttgcggtcatcttcaaccactaggattttgaccaaagtaagtctctcctttttggtacgtgtaagtcgggttttacgctgcgggtcgatgggtcgttgtttgctgaacagtatactgatcccagacatatttgtcatggcttagcgattaggtggataggctggcatcactgatagcaacgagattcgcgataatattttttctgagtgggcgattttttaatggaaaggatttttctatgcaatatacatggctaaacatgcctgagcacaattacttgattgtggttgatcaaggtaagcttgcttttgtcggatcgccggatgccaaactaagcgaagcaacgcgttatatcaaagggccactggtatttgatcgcgaggagatgttgccttttcgcaatgcaatttatgattatttaagcggtgacagtcgggagatcgcggtgccgttagtctttcatggcacaaaactgcaagtggcggtatggcgttatttgatgacaattccatatggtgaaacccgaacttacaaacaagttgccgcagcagttgatcggccacgtgcttttcaggcaatcggcaatgctgtcgggcggaatccattaatgatggcgattccctgtcaccgcgtattacgcacagatggcggactaggcgggtttcgcggtggcttaacgttgaaacgcaaattgttagctttggaacaagggcagcatccaaccttttaatcagtagtaagtttttcaaaaggtagcggttaaacgttctattttacgagcataatcttgtatactgatgaatggacaaatcgaaatcaaggagatattgagaatatgaagattattgcatatggtgcacgcgtggatgagatccaatatttcaagcagtgggctaaggaaaccggcaacacgctggaatatcatacggaatttcttgatgagcatactgttgaatgggcaaaaggctttgacggcattaactcactacaaacgacgccatacgcagctggtgtgtttgaaaaaatgcacgaatatggcatcaagtttctcaccatccgcaatgtcggaaccgacaatatcgatatggcggcgatgaataaatatggcattcgcttaagtaatgttcccgcatattcaccggctgccattgctgaatttgcgttaaccgatacgttatatctacttcgcaacatgggaaaggttcaagcacagctacaggcaggcgactacgaaaaagccggcaccttcatcggtaaagaacttggtcagcaaacagtcggcgtgatgggtaccgggcacattggtcgcgttgctatcaagctcttcaaaggttttggtgccaaagtgattgcttacgatccatatccgatgaaaggcgatcatccggactttgaatatgtcagcctggaagaactattcaaacaaagtgacatcattgatcttcacgttccgggcattaaacaaaatacccacattatcaacgaggcagcgtttgatcttatgaagccaggcgtgattgtggttaacaccgcgcggccgaatctgattgatacccaggcgatgctcagcaatctgaagtccggtaaactggctggcgtcgggatcgatacgtacgaatatgaaaccgaagatctgttgaacctcgccaaacacggtagcttcaaggatccgttatgggatgaactgctcgctatgccaaatgttgtcctcagcccgcatattgcgtactacacagaaaccgccgtgcacaacatggtttacttctcactgcagaatttagtcgactttttgacaaagggaaagacgaatactgaagtgacagcaccggcgaaataatttaagctgcaaaaataagcagcaggcgctctgtttttcggggcgcttttttgtgtgcaaaaattcattctatgactaactcgtcctaaatttacgtagaatcttagcatggtgctacgaggggaaaatcaatttataaagaaaccgtttacaacatctagataatctgctaatataaagtcgttcgaatgaatagtcgttcgaatgaatatttaatctgacgcgcgtctacagttggaatgtaaccctttattcgaaatgcaaagtgaggtaattttttatggctaagaagacaatcatgcttgtatgtgctgctggtatgtcaaccagtatgttagttaaaaagatggaggatgcggctgccaaagaaggtgttgatgcaaaaattttcgcaacatcaactgctgatgcccacgacaaattagattccgaaaatccggatgtgttaatgctcggtccacaagtgcggtatttagagagcgacttcaagaaggatctgagtattccggtcgaagttattaacatgcaggattacgggttgatgaagggtgataaagtccttaaagcggcgctcgatttaatcgacaaaaagtaggaggctctcatggacgaaaaacaacagttgatggtgatgcaactgatcatggctggcggtaatgcaaagggatcggcatttgaggcaattaaagccgcaaaagttggtgactttaagacagcggacaccaaactaaaagaagcagacaaattcttggccgatgcgcacaatgcacaaaccgggatgttgacagatgaggcacaaggccatcatcaacccgtttcgttactaatggtacacgggcaagaccatgtgatgaatgccatcacttttcgcgatttggcaggcgaagtcgttgatctttaccggaagatttcacaggagtcgaattaattaagggagtgtgaaggtcgtgccaaaaccgagcgagtcgaagtatgacaaaggccgccaagagctgagtctaaccagtatgttttttaatcgctatctattgattcgatatacgaccgcggctttcttttttgctaatttatactggttctttttgagctttagtgctgtaggacttgcaaagtggtggcctttcactttgatcctcacgaccgcagcgattgcagttgaacaagttagtaaatactggcgccgggataataagctaccggtaactaaagtcggatatgcaggacaacttctgagtaactttttggcactggttgtcattgtgaccggtcatggggcaagcattttcccgtttttcgggcaaaaaggaatttcgctgatcaccacagttttattaattggtctgggtatttgtttttatattttggctcgggttcatttaatcgaaacaaatcgtgatcgctatttaaagcgaatacgtcaatttgcccaaagtcttcaataagttgaaacgaggagattaaattatggattcgagtaataacaaactatttaagtttatgaacgctcacctgatggggccaatggggaagctggcctcgtttagaattgtgcgtggcgtgatggcagcagggatggcatccattccgtttacgattgtcggttctatgttcttgattattaatgtgttaccacagagttttccaatattgacagggctgtggaagaactcatttgacaagatttcaaacctctacatgttagcaaacggcgcaacgatgggaatcttgtccctttatttttgtttagtatttggctatgagtatacgcggattcaagcacaggaagagaagattgatgtgaatccgcttaatggcgctctgctttcgatgatggcattcttcatgtgcgttccggaattggtcttcaagggtgggacggcaactttaatcaccgagataactaaggacagcaagattattgacggatatgcgattgccggtggcgtcacacgtctaggaactactggcatctttacggccatcatcatgtccattattgcggtaaaactatacgcatggtttgttaagaagaatattgttgtcaagatgccagacaccgtaccagcaggagtttctcgatcatttacggcattgattccaactgcagcaattgcactaactgtcattgtaatcaacggtatcttgatgatcttcaataccgatatttacaaaattgtggcgatcccatttggctttgtgactaatctgacgagcacgtggctaggattacttgttgtgtactttatcatgcatgctttatggattgtcggcattcacggggcaacgattgtgacctctttcttaacgccgattgtactttccaacatgcaactgaatcaaaagggcgccaatattccatttgctggtgaattcaataactgttttgtcacaattggtggttccggtgccacattaggcatggttatcttcattgcattctttgcaaaatctgctcagcttggtgctttgggtaaagcttctatcgtacctgctttctttaatattaatgaaccgattttgttcgggatgccggttgtttacaacccatacaccgccatcccattcttcttagcaccaatggcttcgatgaccattgcatattttgccattgacttacacatggtaaaaccgatgattgcacagcccgcatggccaacaccacttggtttgtctggttttattggcacggcgggagactggcgggcaatcgttctagcctttgtttgcgcattcgttgccttcttgatctggttcccatttattaagttttacgatggcaagctgtatcaagatgagcaaaccaaaggcgcacaagaagcggctgcctaaggttttgttaacggtgatttagatgatttaaaaggaggaaaaaagttgtcagcatttcctaaagattttttatggggcggcgctgttgctgctcatcaatttgaaggtggatggtcagctgatggaaaaggaatcagcattgccgatgttatgaccgccggagataatcaaaccaaacgtcgaattacagatggcgttcaaccgggtgaaaactatccgaaccacgatgccattgatttttatcaccgctataaggatgatgtcgagcttttctcggagctggggcttaagtgtttccggacgagtattgcctggagtcggatttttcctaaaggcgatgaggaacaaccgaatgagaaaggcttgcaattttacgatgatttatttgatgatttgcttgcccatcatattgagcctgtgattacgttgtcgcattttgaaatgccttatcatttggttcaggcttatggtggctggcgtaatcgtaaacttatcggcttttttgttaaattcgctaaggttgtctttgaccggtataaagataaagttaaatattggatgacctttaatgaaatcaataatcaagttgggatgcttaatgaatggtcgttatttacaaattcaggattgatcattcatccgggcgaaaacaaagagcaagctatgtttcaagcggctcattatgaggcagtagccagcgcactagctgtccaaatcgggcacacgatcaactccgactttaagattggctgcatggttgcaatggggccggtttatcccgcgactcctaatcccaacgatgtttttaaagctgaacgaatgatgcagacaaattattatcttgcggatgttcaggtgaaaggacactatccggcctttttagaacactattttgctcgacgccaatttaatttggacatcacattagaagatcgcgatgtcctactggccggaaaggttgattacattggattttcatattatgcgtcccatgttattaaagccgctgatgaagaaccgactgatttcataacattgggttccaatcaggagattaaaaatacgacattacaccgctcagattggggctgggaaattgatccggttggccttcgttatgcacttaactggttcagtgatcgctatgatgtaccgttattcatcgtggaaaatggtctgggcgcgtttgataaagttgaagaaaacggcagtatccatgatgactatcgcattgactatttacgccagcatattgaacagatgaagttggctgttgaagttgatggggtcaagcttatgggatatacaccttggggcattattgatcttgtgtctgccggaaccggccagatggagaaacgatatggcgtcatttacgttgataaagacgatcagggaaaaggaacacttgccagaagtaagaaggattcttttgactggttccataaggtcatccaaagcaatggtgaggatctcacctgaacttgcctagataaacagtgatactgatccacgtttaagctaaaaaagaagcccaagagaatttttttactcttgcggcttttttattgctactttgaggtgatcgtcttttaatatgacatgccactaaatggattgactagttcatctattgaaatggggttataattcaggctaagactttacgaacgagtatgagtgacgaatatagaggagtggagaagttgtcacaacgggaaagcagttatagcacaaaagaacttgtgaatcagctgctgaaagatattcaacaaggcgtgatccaaggcgcagatgggcaacttccaactgagccggagttgatgaaacagtatcaggttacgcgatatacgttacggcaagcattgaagaatcttgccaacctaggttatatctatcaagctcatggcagtggtacttttgcacgcccgcaccatgtagaaggcgcaatttcgcttcaaaataatgttggactgacggcagaaatggcaaggcaaggcaaaattgttaagacaaccggcattagtcagcgaattgtgccattatcaaaggcagcttttgtacctgagagccagaagttggcgcaagatactgaactcatttcagttattcgccaacgaacattggacgacgagccttttttagtggaacattcttattacttgaaatcaatggtaggcgaaattccggatagcgcactaaaaggttcgttatttgcttttatcgatcaaaagccaggactaaaagtaggtttcattgattctgtcattgaatgtgaaatgataaccggcacaccggcgcggttttttaacctagcagatggcagtccgagtttagtggttcgtgatgattcgtatcttagctccggaaaattatttgcgttttcaaaaatattttatgatttccgaaaaactaaattctttatgcttaagaagatgcactagtttttatataacatcgaaagttaaaaacgagacgcgctcaaattgacgaggcgtctcgttttgatgtttactttaaaaaatcgagttacccagcagtgccataacataagtgaataatgccgcagcgttgaccagcatagatactacaatgatcgtgaagcggaccgtgtacggccgcgttccggttgacgcattaaaaaaccgggagtgtcgctgaccgcgataagcaaaagtaaaaccgattaaaagaacaacaatgacactctccacaatcgcaagcagtaagaagatcggtgggtttgggttggcggtcacgagaaaataactaccaaatgcaatcaaatcaaggagcaaagaaatcagaaccattagcatacctccgttgtcaatggtgagtggcgtcggtaagtatcattattcgggaaagaagagcgtcaagcaagtaaaagcgccgggaatagcctgaacaaagtaaattttcttactcatcgttgcaccgccgtataaaccgacaatggccacaaagccggttagtaaacgaagcgtgatcagttgattcgggccatttaacagcaaaagacttagtagcatgacaacggccagcgcaccattgtaaatgccctgattcttcaacagcatttgtgcatgcggttgtttaacaaagtcaagcggtaatgccagattttgcgcctgactcgttggtttgccgaacatttctaaagccatgatggtgagatgcagcagactgagcaagccaacaagcaggaaactgatacgtgacatcgggaaaatcctttcttgggatctattagctcagatcgacattaaataaacggtcgaaattgtgctagtgcaaagccgacaaccgtgacgagcacgaacgctgcaatggcactccagatgatgattttactcagatgctgctgctttttgtcggcaaacgccatttcgagcaaaccgatcaagccaatggcaatcagaatcttgatgaccgttaacatgggattgcggttgaaagcaaaccgcattaagaccacgccgctgatgatggagacgaggtaacaaacccgcgcaatcatcgtccacatgacaaattgacgagtacgactaaaaagcgcaatgccggcagcaactgccaagacggcccatgaaatcagatgtaaccacagccacataaaaataccccctttttctgaaatcaaaagtactagtcccactataccgctttccgaaaagacgtgcgatagccagtgaaaattagtaaaacacgaacattaaacacaactatttgaaaaataaacgtattttctattgcaagttgcgacattcttcggtaaacttttcatattcaagttaggggagcgtgtcatggaaaacttttttcatttaaagcagaataagaccacgccgatgacagaagtcatggcggggcttacaacattttttgcaatgtcatatattttattcgttaacccgcaagttttgtcacaaaccggcatgccggctcaggcggtgttcttggcaacgatcattgccagtgcggttggtactttggttatggggttgtttgctaacgtgccgtacgctttggcaccgggcatgggcctcaatgctttcttcacttacacggttgtcttcgcgcttggttttagctggcaagaggcgttggcactggtgttcatctgtggtgtcattaacattttgattacggtcaccaagattcgaaaattgatcatcgttgcgattccggaagccattcaacacgcgattggcggcgggatcggtgttttcgttgcttatatcgggatcaagaacgctggctttttacagtttacgtccgaagcatctagcattaataccatcaacggccagccgcttaaggaaggtgcattgaccctcaagcacgggattgaatccgtggtttcaaacggcggcattgttccggcgctggttaacttcacccaagccggtgccgtgttagccttgatcggtttggtcatcatggtgatcttgaacgttaaaaaggtgcctggtgctattttgatcgggatcttattaaccacgattatcgggattccgatgggcgtgacagatttacatctcagtgccgccaactcgtttggaagcacatttgcctcactacagacaacttttggcgctgctttttctgctaaagggatggggtcattgttcgccaatccagataaaatcgtcctttcaatcatgacgatttttgcctttagtttctcggatatttttgacacgttgggcacctttatcggaaccggccgacgcacgggtattttctcggacgctgacgaacaggcgttggaacaaggatcaggtttctcatccaaaatggatcgggcgttgtttgctgattccatcgcgaccggggttggttctatctttggtaccagtaacgtcaccacttatgttgaaagtgccgctgggatcggtgctggtggccgaaccggtttgacttccgttgtcgttgccggtatgttcctgctcagttcagtctttgcgccattcatcgccattgtgccgacccaagcactggcaccagctttgatcttagttggtatcatgatgatgagcacctttaaggaaattgaatgggatgacttgtcccaagcgatcccggccttcatggcatcaattgtgatgggctttgtttacaacatctcatatgggatcgccgcgggcttcatcttctactgcctgatcaagctgatcacgggcaaggtgaaggaaatccatccggtcttagccattgtgacaattggcttcatcttgaactttgtcatcttggcatcactttaatccaaagcttaaatagacttttaaaagaagccgaaacagccaccgttacttactgagtgaataagtaaggcgagctgcttcggcttcttttttagttgggtgacttgtagtatcctcatgctgaggtgatagacaatggctttaaaaacaatttttcatttggacacaacccaacgctgggcgcacttggcttcaaatctcaacaattatctaggcgctgaacccgacactgacatcgaagtactggtgaatggagacggcatcaccgtttactttgacgcgcaagtgacggagttcattgcggcgcacccacaggtaaaattctttgcttgccacaattcacttcagcagcgtcatttagacgaacggcaattaccggcaaccgttcaagtcgtgccagttggtgtggttaaactggcacaagcggaagcggctggatatgggtatattaagccgtaatcaataaaggctgatagggtcgttaaaatcgtgaggggatttttgcaaccttataggaacgcggaggaatttcacgatgaaaaagactattgttctatgtgcttttcaaccggtgctggaactggacttgtaaataaactagaatcctactataaaagtcaacgtatttacacacgctttgctgattttgtaggtactcgtttcagaggttccttggacacattgcctggaacgacagtcgagtatttgacaggtggtaattctgcaatggctgctgccagaacactctttgctgtgaaatttagaattcctgatttaacctatgactcagctggtatcgcaaaggcatttaaggaattaattgatggacatatggagcgatcataaaattggaataggtgctttgtttttgattcttgtacttgcaaaccaaactttgttgtgtacatggcagggtataggattacttgttctagggattatcctgttgtttgtgggggctttttcagatgagcacagcttttggcccaaggtagcatttacattggttatggcagctctcttcttacagacacatcaatatgctggttactcaacaatgcgtattgttagtcatggacagactctccaagtctttgcccaaaagagcacgtatggagaaacaacatacatgttcgaggtttatgagaaagggagctttctctatcgcaaggtgaataagaacacgattcaatatgtcaccgcgtctaatacaagttcaagacaagtcttcaaaatcgtatggccaaaattacgaaaagaatagcgtaataatgatttagttcgttactgagtatctaacgtagatctcagataggatagttgcatggtttgctggtagtcttattttaagattccggacttggataggttaaagttatttgtcccaagtgtttggggggcatgattgaataccacatgaaatgatcaaggagagtggtttagaagagactttttgatgagactgcataggtcctaaacaaaaaatctacctcatttttagaaaattgagattgcgctataagtagtttcaaataacaagcgccgccgctgagaactgaaaaagttcatggtgacgatgcttgttttcttgttaataaaaaatgacccgccattaggccgcaaacgttcaattgcaaggtacacttaaaacggcttcgataacccttatgctttaaggaatactgaagccgttggttttttagccttttcttatcgtaaacagttggcttgaacttttgtgaatacaagactagtttgctaacgatcccagttagctaatcccattcaacaattcctgacgcagatttgcgtaagcagggtcggcataggcaacatctggtgctagttggaagaaaggatttttgtaggtggctttgatgatgccggggtgcccgttcatcacaacgatccgctggccgagaaacaacgcttcgtcaagatcatgcgtaatgattatcacagcattttgagttgcctgccataagtcaaacaacagggcgtgcatatcggcacgagtgtgattgtccagtgcactaaatgattcatctagcatgagtaagggtggctggttaataaaggcgcgggcgagagcaactcgttgttttaggccgccggaaaggtcatagataggctgattggcgaaatggcgcagtccggcgcggtcaaggagagctggtagattgtcagctgattggtaacgcattttaggaccgaatagaatattgtcgcggacatttaaccacggataaagtgccattgattgaaagacgacaccgcgttcccatgacgggcctgcgatagggatgccgttcatggttaaggttccttgactaggtggcaggtagccggcaatcagatttagcaaggtcgttttaccaatgccggaaggaccgacaatgacggtggtcgaatttgatgcaatgtttaagttaatattgtggacagttggtaagcgctcattttggtaacaataagctacatgatcaagtgtcagtaatgacatgattgccccctagttgagatatcgcggtgtaatgaaacgatcgcagtctttttgactcactggtttggttaatgtttgttggcgccacataaattgtgccgtttcgaaaaattgcgcgcgaaattgtcgcgtcataaatgttcgttgggattgatcggatagccattgagaggtgccaatctgtttcttaacggtggcaaccggtagcgaaaggctcttggcggccgttcgatagatgctttgaggaagatcttgatactggctgtggatcttgtttaaagttgccaataacgttcgaagcacatctggctgtgttcttatgaaagcatctgttgctagggtcacattggcggttaggtgaccggtttgcgccatttgacgactatcaatcagctgtttgttgcccaataatgccgagaggctgggttcccaagtataagcaccatcaatatcaccacgctgccaagccgccacgatttctggtgtttgcatgtcaagcacctcaacctgattggttaagtggtgctgctggagtagcatcatcaagctataatgcgatgttgaggcaaacggggtcgcgattttcttatgcttgagttgtccccatgtgtcgattccggctttttggcgaattaccaaggcctcgttactgccgatgatgtcgttaatccacactagtttagcggaaataccggcagccagtgcaaccacggcattggtgtgccccatggttgccaactgaacatcattggcgatcaaggctttgttggcatctaccccagagtcgaaggcaatgaactgaacggttagcccttttgcttgacaggctttctgcagtaggtgacgctgacgggccacggccacatcgttaggaacccgaaggacgccgattttaatggtccccgctgatgtaggtgtggcgtgacaactgctgagcccaagcaaggagcagatgagaagcaacacccacagccataggcgatgatggtttgtcatgatgcccagtcaactccttccttgccatttgatgaaatgctgaccgaatcgcttgagtaaccagtctagtaacacgccggtaaggcccatgacaatgatatcgactatcatgacatcacttttaagataatgcgaagcgtcgatgaccatccacccaatgccactggttgaggcgatcatttcagctgatacaatcgttgtataagccatcccgacagcagaacggataccggtcataataccgggcagtgcggctggaaatacgatacgggtaaagatttgccgagaattagcgcctagcgaggcggcattatgccgatagtcaagattaatacttgacactgcatcgtatgcggctaagtaaataggtggtagtgcagcgagaaacaagagtaagatttttgaagattcaccaatgccaagccataaaataagtaaggtatagtatgccaatggcggaatcgggcgaagaaactgaatgatcgggtcgataaactgcccggttttcacatgataagcgcttagtaagccaagtggtgtgccgctcatgacggctaggacaactgcaactgttacccgtctcaatgttagtaaataatgttcccaaaaaggcgtcccattgtatccgaactgcaagagattcaccgctgctagccaaactcgtcccggcgaaggcaaaagaactggggacactaaatgaagccgcgtggcaagccaccataggctcaagataactgctggtatcaatagccacccaaaatggcgggatagtcgatgtttgatggtcatgatgggatcctccgttggcaaaaggctgaaaaccacaaatgtctagaccacccaggcctagacatttgtggttgatctaaaaacctagagcaggtcgaagcgatagttcgtcacaattggtttccgattctgagtcgtgtcttcgaaatattcgaattcacagagatccaagaaggaacccgcaatgttgtaaatattatggtaacctttattgccaagcgctcgggcaacgttgtaacttctttgaccactcaagcaatggatataaaccggttggtctctgggaatctcatcaagatgttcgcgaaaacgactcatcggaatgtttttggcagagatgatgtgaccttctgcaaattcatcaggctcccgcacgtcaatcagcatcgcgccagcttcgactaacggacgaacttgtgaaaccatgatttgtttaaattcgccgtttaagatattcgtggccaccagtccagccatattcactgcattctttgcggtgctaaaagttggttgatagcatagttccaaggtctcaagatcctcaacataattgtgattggtgatggcggtagcaataatatcaatctgcttatcaacaccgctttcaccgatagcttgtgcgccgagaatttcacctgatggatacgcgaagatcaatttcagatagagcggtttagcgcccggtataagtgccactttatctttagggatcacaagggcttcccgatagtcaattttggcatcttggcattggcgggcagttaaaccggtggaagccacattcatgttgaagactggcaaacactgggatccaatcacgccacgattgcggatttgacgaccgaaggcatgatcgacggcttgccgcgcctgtagttgtgctgggaaggctagattgaggcgtgttggttgccgtaagagacgttgataaacttcaatggcatcacccacagcataaacatgcggcaaatttgtttgaaaggcttgattaacttgaatattgccggttttgcccaacttgatcccgctttgttgagccaactccgtatccgctttaacgccaatcgccatgatgacgatatctgtcggtaattccttaccagaagctaaagtaatgtggtcattctcaattgctgttaatgtgtcgtgaacgattaaccgaacatcgttatcgagcattgttttttggacaagttgtgccatatcttgatcaatggtggccagaatgtggtccgcgccttcgattaaattgacatggtaaccacctttaaccagattttctgccgcttcaatgccgataaaaccgccgccgatgacggaaacattagttgctttgcgatctttaagcgcagtagccaaggctttaatgtcgtcaacattgcgaattgtgaagacattggtgttctgaatgccgtgaatggatcgcggcagaatcggtacggcgcctggggacaggaaaagatcatcatatgaatcggttgtcacttccccagtacgaacatccttgacggtcaccgtttgtgtctcagcgtgaatggctgttacctcatgattgacgatcgcatcaatattatattgttgcttaaattgttcagaatccatcaaaacgatactttccgcgtccggaatcatgccagataggtgatagggcagcgcacaatttgaaaatgagacattcgggcccttttcatacatcgtaatttgtgcagattcatccaatctacgtgcgcgtgccgcgacagatgcaccaccggcgacgccaccgataacaataatctttttactcatgttgcatatcctccttgagaagtttatttggtagataggttgggcaaagcgctaatttaccttggaatagtttgatagcaaaagcagcccctaagatcaagaaaagcataaagatataaccgtgtaacgaaaagttggtgatagatgagtaaagcgcgccaatgttgcagccgcgtgccattcgagagcctagacccatgagtgcaccaccaagagcatagccgctaaaatctgccaacgacattttgagattggctttgaaccgacctgccagcaagaaagcgatgagtgccccagcaacaataccaatgttgcgaacagttccgccgtctgcccacaggggaccgctcatggcctttgcggtttcgtcaaaagccggtgaagtgaaatgcatcccgaacaactgcaggaatttttgatccagtgtgacaaatggggtggtgacgccccatgctttattagtggtaatcataatgaagctggcagcaagtgtgagtccaattcctccagccaaaaatgaccagcgctcaatgaataatttgtgatacgtttcccatgaaagccatttgagaggcgcggtgtcgttgacaggcagcggcttttcgtagtcagcccaatccgattggggatgtaaccaggcaccggacgcttttttcttgttctcataggacttcgttagcatataaagcccaaatagtagcgcaatcgtgagaaggatggcgccccaataaccaatatattggggtagccacacgttaattccaattttgccaatggcagtattgtcaagcacgtaaccgaagtattgccctggtgcggcaaaaagaatgaagaatgggaaggcaatccaggcatgaccctcaccttcaccaaaatcggataaggttccggaagcgcaaccgccagccatgatcatgcccattccgaagagaaaagctcccagcatgacggaaatatttccgattcgaacgttttgggtgccagggatcagcgcttgattggcattggtaatctcccaagcgggtactgcacctttactagcagcaaaccactgaatgccaaagttgatgagtgctgtggtcaaaagcatcactagtagcgccaccgttaaactgctttcgccacgataaaagatacgcttgacgccgccggcaaaaccgaatctggaacgtgtcagtatataaccgatcattaggccggcaaataaggctattggcagtgaagctgatgatcgttgtagaaaaatagcccacacacctgttaatatcagcacaatcaggccgataaatggttgatgtttattcagcccatagcgatcgaacccttttgatatcatggaaaccccccgatctttttacaattaaaatgtatattatttcacaatttaattgaaatacttattcaggtcctttaatataacctgtagggtatggcgttattttgggggatgatttagtgaaggacacaacacagtttcttacctacttgcgaacgattatttcaactggcagcgtgacggcggcagcgaagcgcttgtatatttcgcagccatacttgagcaggaccattagtgaacatgaacgtcgcttgggttatcgcttgctggatcgcgataaacgaccaatcgccttaactgcgattggcgtgcaatatgttcgcaccttggaacaattaaataatcaatataataagctgatgcatgatttagaaaaaatggcagatgtcagccacttacggttaggcattaatcagtcaatgtcgacaattgtggcacccccgctactgtatcgatatcatcaggttcatccagaaagtcagattgcgtttactgaaggtatttccagcgaattgggcgatttactgttatcggggcgaattgacgcgcaattgcgattaatgccgattttttcgaatgaaattacttattatccggtttgtgaactgccagtttatttattagtcaatgacagttcatcgcttttcacacccggccgacgggaaattttgacgctgccggtcaaagctgctcaattcgatcaactagcatatatcacgttggattcaggttcgggattcatgagacagctaagtgtctttttgacgaacaaaagattcatccaaggacggcttttaacgtgcggttcattcaaactgccgctaatcttgcgtatcagggcttgggatgcacatttgtgccgcaatactgtcttcgccgccagtttgatgcgtctcaatgtaatattatcaaggtacccatggagcaattgtccgttaagattgttcttgcatatcgcagggattccggactggcgagcaaagtacaacagttaattgatgaaacagagttaccgacgttgcttcaggaactttgtcaggattaaagtgtgatcgctaccgtctgagaagcgctggaaaagcagatttcaagcgctgctgttagattagttcaatgaaaaccacgcaaaaagcacccacgatcaaaatattcgcgagtgcttctttcgagttctgacataattggaggagcgggaatgcgcgtggtgatctaagatttctccacggcctgcagcggttctgtattaaacggaaccaactgccgctcgattgcttcacgctggtcttccaagaacggtggcagttccaaatgcacgccggcttcttcgtaagtctcgtcaagtaggaagccagggccatccgtggcgatttcaaaaaggatgtcggaaattggtcggaagtactctgaagcaaagtagaagcgatccacaaagccagaagaattcaaaccagcattcccgattttctcaatccagtattgcaggctatcacggtcgtcagtgcggaaggcaaggtggtggacgccaccaaagccttgataagctgcgggtatcaaccgctgataatcgatgatgacttgcgcaccgtggccgccgttgttcagttcaagcaaggtgtgttgaccgtccttggcgatttgtttaaagccgagcagatcggtcatgacactgattaactcatcatagtgatcagtcgtgatgtactcaggaccaagaccgccgattgcaaattgtgggtcaaccgtcgaatgtcgccaaggggttcccgctggcacgccttcattgtgttcgtcactgatcagctgatattgctggccatcaaaatcatgaaaacggagaatcttggcgccaaatagttcgtcaatcgcatcatggcgcacgcggtgatcatcaaatcgtttgatccaatacgttaatgcagcatcagaagggacccgaaaactagtgcgggcgatttcgttgttgccgtgttgtgctttttgaatgccgggaaaatcaaagaaagtaatatccgttcccgcagttcccatgtcatcggtgaaataaaggtgataggtacgaacatcgtcttgattgacggtttttttaatcaggtgcaagcctaaaataccactcatgaaccgaaaaattcgtggtgagctcgatgtaattgcggttagatgatgaagaccggtgagttgattagccatttcgtatccctctcttgcttacatttagtaagtaaaagataacatggctcaccttgaaaaacaagctttgcgttttggttaaaatcattaaggtcttatcaaaatgcccgttttcggccaagttgctgggcgatcgcgtgatatgctcatttcaatcatataagtggatggcaaaaaggagcgcatggcgatgttcaattttcaggataatccggatgagtataaacggttaatgcagcttgaagttttgattgcgattgtggccatcgcggcgagcatcgtgatgttcagttttggggtcatgaccggcgctttgtttgcggcaattgctggggcctttttccttatggatgccattgttgagggccttcgtttgctaggagcatcgcgcggttttagccggttcattggtacggcaattgcgattcctgctttggctggttatttgatcatgatgttcaatcgattcccgttgcaagtggcttaatcaaagttatttggctaccacgctgtcagttagcggatccggtaacaccgaaaccatgacgtattttaatcgcatttgaaaataggcccctgagataacacggttaagctgtgttttctcaggggcctattttgtttgggtatgagtaggggtcacctataagtcggccggtctaaaaatggaagtcttccttatccgcaacatcttcggcggtcaattcatagcgaaccagtggaactttgctgccgtctggtaaggtccggtcatgatgataatcgccgactttggtaaagaagttggtggtcaataacttggcgccgcgttcattggtcgcaggcaagatgacataaacccgcttcaacccaagctcaaaaaaggcaaagcccagcatccgtttgatcacttcactcataatgccttcgccttgatggctggcaagcgtttcaaagcgtacttgcgccacggttttcttttggctgaaattccagatacagaaactgccaaggaattcgtggctggcgcgatccatgatgccataaagtaaggcgttgttgctcattaccagccgcatcgaacggttaatgtagcgggcagtgtctgtaattttttgatcaaattcgcgtccggattcggcagcaacttggcggtcggcgcgcaactggaaaatgtctttgatcttaaaggttgtcagccaatccatggtgtaatggacggacataatcggatggtatttttcaaagctttgcatgataggagcctccgtaaacatgatgttaagtatgcgtcagcccaatttaaagcaggcgtgtgagttgcaacttccagtatcgtgacgcatctaggtcatggtactcatcgtttcctgcttaggcgtttgggactgagaacacttgctggagttagcttaacataaaaaccgccaatacactgatttgaaaaccattcgcaatttggtacggaccaaaaggctaaagtcaagtcccgatcttaattaaaaaacacttgagcagacgtatgttatcaagatgtggtagcgaaaacttggagattttcaactaatagcgggctttcttggcctgtatggacgcggtttgtttaccgtcttaaaaaggatttttttatttttttagcaggcaaataaaaactgaaaatgacaacatatagttttagcttatataatcataaacatcgcaaagggggtgagtaatttgaaacagcttttttttggctcatgtcggggttaatgctgctacaaccggttgggttaaacgtggggcaacaagttgaatcggcgctggcgagtcaaccgacaacatctggtcagccatcagtagcaaccagctcgtcatcggtagctagtcgcgaaagtttacaaacaccgagcgcggcatcggctgcaagtgaatcagcggcaacgcaggcatcggtgccagcagtggtcggcaagaaacagcaaccaaccagcaccacaacgccagccgaatcaaccacgctgaaacgatccaagcgggccacttcgccagagtcaagtaatcaaccgcaaccgtgcttggttcaaaccgccaaagcattagccgaagcggtacggcgaggcgaaacgtatatccgcttgactgctgacattaacatcggtcgcgcggcgattccggtcaagcattcactcgtgattgatggtgatcacaaatacacttatatgtacaacggtggcgaaaactggcatgtcggtttgtactttgccgccagtaatatcagtatcacgttcaagaatctgaaaatcggtgatccgcgcgtcaagaactctgccaacaattattacggcattgcaccagcggagaacctcattaagaacagtaagattattgtcgaaaatgttgattactattctgatcgcggggcccagccgttccacattcgcaacgcaagcaaccaaatcgtcttcagagggaaaaattcatttcataccactaaaattgctggatcggttttagttcaggaatttgctgaagcgactaactttctttttgaagaagattcggataccacgattaatatggaaaatacagagctaatcggtactttctggccatcaaccggcccgctgaacctaaccctgaaaaatcgggcgcgactcaaagtggttagcgccaatgcactggtttattcagatggcggggcgttgcacaagaatcgcataacagttggggaaggcgcggtcttagacgttaagctcacagacaaaaaagatggcgtgctaatgtaccatgaccacgatttaaccattgatgtccaaaaaaatggccgttttctagccgaaacagttggagcaaacaactttaacaagaattccagcctgaatttagggccgggtgccaaagccgaattgaaaaacactcacggcgatttctataaaaatggcagtgggacgattcgactcgacaacgctgacgaattgctgatgacctcgggaagccatggtaaaaccagtccaaccgggttgtcagcatcgaaaccaacgttaacatttgcccctttttccactgatacaaaaggatatggcatttatgccgatgatcaatgggtcactgatcaagctgatacatcatcgtgggcatttacgccatcccggatcaaacgcagcccaactgctttgacgagagggcaggaacaccagattcaggcggcatcacgctttaaggtggttcgtaatgcaactaaaggcaccaccgaaagccctaagaatccgccagtcgtcacaccagctaaaaaacccggtcagctgcttttgaaacaagtaccggattttgattttggaccccgtctgatcaagccggagacccagatcctaaggcccaaagttgatggtgaattcattattgaagacactcgaacggcggcagctaagtcagtcaaagtctatgtcaaagttataaagccgtttaaaaatggcaatctcgatgtgaccagttgtctaagctacatcaaccgctcaggcacggaacaacagctttctgatcaagctgttttggcagaagagatagacatgacgtcaccgcagtcgttaagcagtcagtggaatcaggccactgacgagcaggctcgtgggctcaagttagtgttgccagtcgagaagcaaaagttgggaacttttacaggtgagtttgaatggtcagttcaagatgtgccgaccaattaagagggtggttccaagtgatgaaaaagtggctactgctggtagttttgctaatcggttttacttgtccaccatcgcaagcgctagcagtcgagacacaaacatccggtgaaattagcttttttgaagttgagcagccggttaatcaaccgtcaccagaacagatcaagccaaagcaacaggtgaacgtaccaccaccaaccaaagaagaccagctaccagccttgggaatgatgaccccactgcttgtgagtttaatcgggctactactggtgttgctgatgctactgattttgctgacaaaacaatctaacacaaacaagaaagaggaagaataaacatgaaaaagttttacgtgatggcatcaatgcttggattaggtatgttgggtttggctggagtaacaccgacactggtttctgctagtgatgtgacttcaaatggccaggttaagtttaagttggatcaaagccaaactgacccgaaaaacccattagatcccgctgataagaacccaggcaagccgaccgatcctactcatcctggtggcaaagttccgggtggcaccgggggcccgttgtcgatcgactttgcttcaagtctcatttttggagaagctgaaattagtcatgaagatgcaacgtattacgcaaaaccgcaaactttcacacaagacgatggcacaaccgttgaccgcccgaactttatccaggtgaccgacaagcgcggcacatttgaaggttggacgttaaaagtgaagcaggaaaaccaatttgcggttaaagacgatccgaccaaggaattgaccggcgcccaactgagctttacaaatggtaacttggtttcaagcaccgacgcacaatatgcaccgaagttccagaagtcatttgatctcattccgggccaggcacaaattgcgccagttgaagcggctgctgatcaagggatgggcacctggatctaccggttcggcgatgataaggagatggccaagtcaattgcgttgtcagtgccaggcaagaccccgaaaatggctaaagcctacacgactgctttaacctggtcattggaatcaacaccagcgaataccacaagtaccccaagcactacaagcacgccaagtacaacgggtaccaccaaaccttaaaaagctggaacgacactgatgatttttggctagcatcaacggtttgctaacggacttgaaacattcaaactcattggagaaggatacgatgacggcactaggccgcatcgttgggggaacttaatcaaaaggagatactttgtgaagaaaaaacttttctgcttcataacgcttattgtgatgttgatcatgcctgccactcaagtttttgcttcggaattaaactttgctgctaaagccgagttaccggacaatcaagtgaatcctgatgttagctattttgacatcaaaatgaatcctggcgcgcagcaaacgttacatgttcagttgcgtaatgaaaccgaaaagccagtgacactcgatgtcgagcttgccagtgccaccacgaatctcaatggcgtggtggaatatacacccaacacgattaagccggcaaagagtttgcaattcaacatgaaggattatgttaaagcgcccaagcaaaccgttattccagctaagggcagtaccgttttggatttagctgttaagatgccggataaaagttttaatggcgtcatggctgggggaattacccttaaagaacatggcttgagtgatcaaggtggccaagcatcaggcaaaaaggttgcgatcaaaaatcgcttttcctatgtcatcgggctcctgatgcgccaaaacttagccgctgttccagctcacgttaaattgaatgcggttaagccaagtcaggttaatgcacgcaatgtcattttaacttcgatggaaaatgatacggcaaccttcattcagcaagtagccgtggatgcaaagatctttgctaaaggttctaaccaggcactttaccaagttgccaaagaagggctgcagattgcgccagatacgaactttgattttccaattgcgttggcggggaaagcattaaagccgggaacgtatgtggctaaactcgaagtctatggtaatcggcagccaaacggaaagatcttacgcacaacggcagaaggtaagcagcattaccgggatcactggaccatgaccaaacaatttaccattaccgaaaaagcggcttcaacgttaaatcagcgggatgtgacgatcaagccaagccatccgcagtggacgtacattctgattggtgctgtgatcgtcctcatggcactgatcatcctgctactgattttgctactgcggcgtcaggctaagaaacaagcttcttaatcaaaattgtctgagcaaggtgtttgcaagttttgaaaactggcggcatcatggacacaaataaaggactctgagaattcgtgaacgataccgatccagaagaaatgatgatatctgaaaattcgcgcctttggttatcagcaatgtttgctgctgatggcaaaagtgggcggatttttgccgtgagttcccaaagccgggtgagttatcgttggcggcgtttgaacttagccaatttagcgtatcggcttgccggaaaaacattgttggctcaatcgaggatagaacgtgctaaaaagtaaggtggatcttgtgaaattagttgaactgatggaaaaaaacgaccaaaagaagcttcagttactcaattatcttgatcaatatccgaatcgtcaggtaagaaacagcgagttacaggataaactacaaatttcctactatatgtttaagcgatggacaaaagaaattgtggacgatattgctacttttcaactggatgatcgttttagtcttgaagtgacggatgcatcaacgatcttgcatgagcaccataataccaatacttcggtctttttggcgcactatctgaaactgtcaccaaaagtcaatatcctgctgacgctgatgacccaacaagccacgtttaacttagcggactttgccgaggcgaactatgtgagttacacgtttatgtataaacgctatattgcgctgcgggagacattgaaaaagtggcagattactttgacgagccaaggcgagctgacgggcaatgaactcgcgatccggctgctattggccaaaatcatggtggtcacacatgtcactgaagataagtttaatcatgaggttcggctggccttagccgaattgctgggcctcatgaaaacaaccgatgccaagccgtcaatgagccaactgattgaaaccaaggcttatgtgctaattagtttgctccgctgtcaacagggctatacaattgcgagttcccaagaagtggctgatttggtggccaatattcgtcaaggtaccttggcaaccagaaacaaagcgattgcgatctatcaggctcattttgacgccagcgatcaggcaattaacagcgaatgtgactatttagggacatttttggcgattcttggcattattaattccgaggaaatcgtttttccggagacaattaagcagcgcgggcaagcttttatccacggatttgaagtcaagtttaaagtgacattatccgccgttgctaagctgaagattgcgtatgcagtcaataaatgttttgtagatgttttggtattaccgtttcgcagcgagtttttcgatgatcatatcgacattagctacttctttaaaacttacccgggattttttgagtattgtcagcattttgttttaaaccaggccttgcacttggaaagctcacaggcacagtttttgttttaccattgtttgttggcactcgccgccaatgttccgttgagcaaggtattagcaccattatcgatttgcgttgactttacatccggtcacgactacaacgctattattacgcgggatattcagtcattttcaactttgaacattcagatgacccagcaagttgaaccggaaacacaactgattattaccgacttggtgaatgcttatcatgattacgatattccaaaagtgatatggctttctccgccgcggcctgaggattgggaaaatttaattaatgaattactgcgattacgcgagcaggcacaagaagaattccaaaaacgctagaaatttttcgttgcttttttgcaacgaagaattagttgtgaaaatagtgtaaatggactagccacactggattaagcgcctttggataacaacggttattcaaaggcgcttctttttatttaactcaaaacattttgatattaataaatgtaatggtatactcgccctattcaaaaacggaggcgagacaccatggaaaaggaaacaggtttttggccggcgattaaagactttttctttcgtgccggtgattttaaaggcgttagttcacgctcacagtattggtgggtatttctaggacaattcttgttaggcattgtcattggcttggtatctgtgtcgttaggtgcgacattctcggcgaaaacgcaatcttttggcagcagcatgataagatcactcttgacaacattagtcgcggtccctatgtatctaagctacccgcaactgagtctaacgcttcggcggttccgagatgctaaggttaacccatggtggtaccttgtgctggtaatcgttgcattggtcggaccattgctgacggccaacggtatgggcttgttgccaatgatcatcttgccgcttattgttgcactggtaacactcattatccttctattacctagtcgtgaacagaccgtgaagccttttccagctcacccgcatacaggtagtaccactggtgtaggttttggagcggcagtcaaagatctattccttcgtggtggcgactttaccgggacatcgagtcgtagtcagtactggtggagtatcctattttcagcgttgatctttgtgccaacgttcttctttctcgtcttttcgatcactgcagcgctccttggcagcgctgcattaggcaaaatgcaaccgcagaatatcattaatatgattaattcattgggtattggtgccgtgattttggtggcgattatctttgctgttctctatggttggtcgatggtagctttgccaatgttaacggtcacttggcggcgtttcaaggatgcaggtgtcagtccatggtggttcatagctcttaacattgcgtcaagtatcgtctcggcagtacaaggaagtgtcccaaatgtcccattaaacctggtaacactcattcttcttattgcgcaaatcgtcatccttgctttaccacctaaagttcaaaatgacgaagcataaagtaatctgtaccacgcaaaaagtgcaaccttccgcagcggaggattgcactttttaatttgcgcttttagttgcagggtgaatcaataaatacctttttcgtcttcatcaaccagtggatcattaaagtttttgtggaagtacgtgctgtcgatgactttaaacttgccattcgcaaagcgggcaatgatttcgccgtattgaacgatgagtggttcggtattgggaatttcgattttcaggcggccaataggcgttttggtaaggtattgaaaattgtcgccgaagaagccttttaggtcttttgtattggtgtcgtgtgaatacggtaagaaatgggtcattttggccgttgaaaatgccgcaaattcgccttttgggaatccttccaaagatgaaggttgagccatggtattctcctcctaagctaagcgtgagccggtgggcgcgttcatgtgtggggatccaaaacgcatggatcgacttgggcattatatctcaagtctttccacacaggtttatgcgccaatgaacacgtgatgtttgagcgcgttataatgcccggagaggttgtttggacaacatcgcgagtttatgaatttacttatcattatgttaacacaataatagaacaatggaatgattgcgtcgcggcctgaaaacgcttaaaattgaggctggacgttgatcggaggtgagcatatggatcaaagtctgtttcaaaatggtaactttcagccgttagcaagtcgtatgcggccgcaaacgcttgatgagtttgtcggccaaacgcacttgttaggaaaaaacaaggtgttgagtaacctcatcgaacatgatgagattagttccatgattttctggggtccgcctggggttggtaaaaccacattggcgcgaattattgcccggcgaacgcaggcacagtttgtcacattttctgccgtcaccagcgggattaaagaaatcaagcaggtgatgaaagaagctgaacaaaatcgtgaattgggtcaaaagacgattgtgtttgtggatgagattcaccggtttaataaagctcaacaggatgcgtttttgccgtatgttgagcggggcagcattattttaatcggtgccactaccgagaatccatcgtttgaggtgaatgccgcgttactttcacgtactcgggtttttgtgcttcacggcttgacgagtgccgagctggttgatttattgcagcgggcgcttaaggatcctcgtggttatgggctgcagcaagtcaaaattagcaagaagttattagcacagattgctgattttgccaatggcgatgcccgcattgcgttgaatacgctggaaatggcggtcaccaatgctgagacgaagcatgacgtggtttcagtaacgcaggctgatgttgctcagttgttgactaagaaagccttattgtatgacaagaatggcgaagagcactataatttgatttcagcattacacaaatcaatgcgcaactcggatgtggatgcagctatttattggctggcgcgaatgttagaagctggtgaagatcccttatacatcgcgcggcggctcgttcggtttgccagtgaggatgtcggaatggcggattcgcgggcgttagagattgcggtcacggtttatcaagcgtgccagtttatcggcatgcccgagtgcaccgtccatctgacgcatgcggttacttacctctcacttgcaccaaagtcgaatgcgctttacacggcatatggtgctgctaaaaaggacgcaactgaaaccttggctgaaccggttccgcttcaaatacgtaatggggtaacggatttgatgcaggatttaggttatggaaaagattaccaatatgctcacaacacaaaagataaactgacaactatgcaaaccatgccggataatctcatcggcaaaacgtactatcatcccaccgaccaaggcagtgaagctaaggttaaagagcggcttgaacaaattaaagcgtggcatgcacaacacccagcccctgaaccgccacggcctaagaaaaagtcgtgagtgggacgctgctagtgggcgttaacactatcgtcaacttgtaacagttcaatgtgctgatgcagagttgaatcatcatgcgttattcggcggtgaggacttctaagcgcgccggctcacgctcatcttaacgcgttcgccggcgcagggatctgcgtgtaaggaccttggtcgcaatggccaaagagcggccatcacgcccaaggccgcttacactccgatccctaagcgcgccggctcacgctcatcataacgcgttcgccagcccagaaacctgcgtgtaaggaccttagccgcaatggccaaagagcggccatcacggctaaggccgcttacactccggtttctaaccgggctggctcacgctcaccataacgcgttcgccggcgcagaagtctgcgtgtaaggacctcagccgcaatggccaagaccgggccatcacgtctgaggccacttacactccgacttctaatcgcgccggctcacgctcacttgtttaaaattaggaggaataaaataatggcaaagattctcgcagtcaatgcaggtagttcgaccctgaagtggaagctttttgatatgccggctgaagtgcagttggctgaggggttggtcgatcgattgggccagccgcaatcgaaggttaaaattaaatatggcgacggtcagaagtacgagagcgataccccaattgcaaactatcaagaagcagttgccagcttgatgggtaatattaaggcgctagggttagtggagcatttgcacgagattatcggggtcggccatcgagtggttgctggcggcgaaatttttgccgaatcagttgttgttgatgatgagacgttgctgcagattcagaatctgcgcgactatgcaccgttgcataatcccgttgaagcggactatatttcggtttttcggaaaatgatgccttgggcgaatgaagtggcagtttttgacacggctttccaccaaacaatgcaaccggagaactttttatatagcattccatacgaatattatgagcaatatggtgcgcggaagtatggtgcgcatggaacaagtgtccgttatgtgagcgctcgtgctgctgaaatgttgggcaagccgctagaagatctacgtatgattgtcatgcacttagggtctggctctagcatcaccgcggttcaaggcggacagtcaattgatacgtccatgggctttacgccattagcaggtgtcaccatgggcacgcgatcaggtgatattgatccgtcattggtaggctatctcatgaagaagttggcgataccggatgttggccaaatgattcatattctcaacaacgattccggtctgctaggtatctccggactcagcaatgatatgcgtgacttggaagccgccgaggacaccaatacacgcgctaagctggcactggatatttttgtgaaccgcgttgtgaaatacgttggctcttacgttgctttaatggatggcgtcgacgtgctggtcttcaccgctggcattggcgaaaacggtgacgagatccgtgataagattatgcggtcgcttgattacctcggcgccaaaatcgacaatgatctgaattacaagtcacatggcgttgaagcagatctaagcacggcagattcaaccgtgaaaacgctgctggtaccgacaaatgaagaacttatgattgtacgcgatgtgatggcactgagctaaacctgaatcacaagcggttgccagtataaaaattgaacattaccaagacgctcctccaaaaaagcgctagagatgagttttatgacttgtctctagcgcttttttgcatacttgttgcagatacgctacccatttaattaatgcgctcaatcgaaaattcggatgtggttagcgcgagctgcattaacaattgcttcgggcatcactttgtcagtagcaatatagtcaagcgtattcatcggggcactcatatacagttggtgtttaccgactttggtgtgatcgactaacaacatcacttgatcagcgttagcagcgaaagctcgtttgatgttggcttcctgatcattagcatcggtggcgcctgtagcaatgagaccgcggcaagaaaaaactgccagatcggcttgataattctcaatatcacgagttgctttgtctccgctgatattctccagcattttattgacagttccgcctaccaagctaacataccaaccattgcgcttggaggcttcaagcgcaaccaagatgccatttgtgacaatgtaaagttcatcaatatccttaagctcgcgaataaggactaaagaggtggtgctggaatcaataaagagactcataccacttttgattaatcggtttgcgcgtgtggctaccacccgtttggcatccagattcaaggtgaccgaataatcatatggaacatctttaggttcttcacttaacgttacgccatttaaaacccgtctgattaaaccacggttctccatatccaaggtgtcacgcctaaccgtagcaggactgacgaaaagttgttttgctagatcgctgtatctagcgaattgctgcgtattaaggatctttaaaatttggttttggcgttgaaatgagaccactaagaaccccttctttctcaaggtgcatcattttatgcaaaattatagcaccgattcgaaaaaaagtgaaaaattttcgatatggtcgtcaactattgtcaaatattttcaatcccctatactacgagatgaaagcggtttacaaacacaaaggaggtacatcaacgtggcacttatgggattggatctcgggacgaccggtgttaagagtacgattaccgataatgaaggaaatatcctttctgctgcttaccgagaatacgagacatcggttcccagagaaggcgaatatgaactagatccgagtgtggtctggtcagcgactaaagaagttattcaagagtcaaagaagttcgtgaaagaagatgtgctggcagtcagcgtttcatcttttggcgaggcatttgtagcagttgatgctcaaggccaaccgttgatgaatacgatgttgcagacagatagccgtggaaaagacgagttgaatgacttgttaacgcggatttcagccgaagaaattcgcaataaaaccgggttgaatcccgcggtcactttcgcggtacctaagattatgtggatcaagaagcatcgaccggagatctatcaaaaaattcatcgtatcctgctttatggggcttatattctgtacaaacttggcaatgttgatgccattgactacacgttagctgatcgttcacttgcatttaatgtttctaccaacgactgggattcagatatattggctgctgccggcattgatcgtcaactattacctaagtgttaccggcttggtactgtcgttggaacgatcaaaccagaattagcttctgagttgggtgttaatctcgacatgaagttggtgaccggcgcgcatgaccaaatctgcgtttcaatcggtgccggaaccattgatgttggggatgccacggatggtatgggatcggttgacaatatctcgccaatctttaccgacactagtcatctcaaagaaaatgccaagaaaaattatccgaccgttccttatctggataacaaatataccacgatagcttatatgtacgatggtggaacatccctcaagtggtatcgcgatacttttggctttgaagaagttcaagcagcacagttatccggcgtgagtgtctatgacatctttgataagtacgttccgcaaaagccgacaaatttgctgatactgccgcacttttccggcgctgcagttccttatttcgatgaggatgcacgcggtatgattctcggactctcaggagctacccgcaagcctgatatttatcgggcattgatggaaggggtggcctttgaaatgcgaatgaatctggacaatatggaagctggtggcatgcatgtcaacaagttgcgggcgaccggtgggggttcacgatctgatacctggctccagattaaagctgatgtcttcaatcgagaagttgatcgcgttcatatgaaagaatccggaacgatgggcgtcatcatcatggccggtgttgcggttggcttattcgattcttttgagtctgccatgaagaagctggtcacgattgataaggttttcaagccaattccggaaaacgtggcgttctataatcgtcaatataagaaatatcgtgagttatatgcatttggtaaaaagttacggagcttataggagggtaaatcatggttttagttaatacaaaagaaatgattaaaaaggctaaggaaggccattatgcagttggttcatttaacgtgacggacattgaaatgattcgcggaatcgttggtgcagcggagaaggaaaactcaccggtgattatccagtttgctgaattacatgataagtatgtgccactggatgtgattgctccggttatgctaaacgttgcgcgcaaggcttcggttcccgttgcagttcattttgatcacggtgaaactttcgataacatcatgcgagccattcgattaggcttcacttcggttatggttgacgcgtcacaggaaaattttgctgataatctggcccaaactaaagaaattgtcaaaatttgcaagcctctgaacatttcggttgaagccgagcttggaccaatgaatcgtgaaggcagtggcgataagaaagttgattatgccgatctaaataagacgtatacgaaccctcaagaagctaagcaattcatcgaagagtccggcattgatatgttggcggttgcatatggaacggttcatggggtttatacccagaagccgcacttaagtttcagtcggttaaaggaaatttctgatttggttgacttcccactcgtcgttcacggcgcttctggattgacagatgaagaatatcgtaagtcagttgaaaatggtatttgcaagatcaattactattcggaaatggttcatcgagttgcgttgggtgttcaaaagaaattagaacaagatgacagtgataaacaactatttatttcggacgctagcatttgggaaaccgaaatggtcgaagaagaaattcgcgggcgactacgggtcttcggttcggcaggtaaggcttaagcaattcggaaaacaggcggataggggactgtccgtctgttttcaaggaagaaatgagagcgcttcagtttagagaatagacggcgctcaacatataaggaggcttttttatgaaatttctggttgatatgctcagccagccttccatcatcgccggaattgttgtcttagtgggcttgatagcattacgtaaaccgtttaccgaagtcattggcggaaccgttcgagcatttatcggttttgtcgtcatgcttgcaggtaccaatattattgtcggtgcgctgaataactttgctaagctatttaccaaggccttcaacatgcatggcatgattcccagtaacgaagcggcaatcggagtgacagttgctaaatacggaacggttgcaacttttatctttgtctttggacttgtattgaacattgtgttggcgcgtattacgaagtttaagtatattttcttatcaagtgaccatgcgttttacatggcatgttgtttaacgccgattatgatcttaggcggcttaaatacggttgaagctatcgtctttggttccatgactttaggtgtcattctctgcgtcttcccagccatcgcccatccaacgatgaaaattattactggacgtgacgacatgagctttgcccatttcggcacattggaatactggctatcggcaaagatcggatcacttgtcaataagaataagaaatcgaaatcgattgaagatattaatttcccgaagtcattagcatttttacaagatagcaatgtttccgttacgattgtgatgaccatcttgttcttcgtggtgacggcagtggctgggccggcgtatgttggtaagctaaccgacttgaatccatacgtttgggcgctcttgcaagctgctgagtttaccgcggggattatcgtcttagtccaaggcgttaatatgttattagctgagatcacacccgctttcaaggggttcagcgaaaagattgttccaagcgccgtacccggttacccatttgccattctgtttaagggcacatccaacgcattactggccggtttcttggtaagcttactcggcggtttactttctatgggggttcagatcataatcgggacaaccattgttattccggggattgtgatgcacttcttctgcggtggtatcgcggcaatctttggcaatgctacgggtggtcgcaaaggtgcgctgattggaccgtttatcggtgggattattctaagctttttgcctttggtcgccaccggtctttatggaggcttgggttacactgcaacttattggtctgatagtgatttcaatacaatcggggtcttacttggacttgttgctaaagttggtaagtggccgatcatgctggctgcattgattatctttgccttcccatttgtctttagtgctttacacaagaaaaaactggttgattaatagcaacttttgaattaatagcgctgatatataaaaagtcgatctcatgaagagtggccgcatggcaaacgcgactgcttttcaggatcgactttttatgtactgcatagcgatctgagttttctaatgcgcagattttcagaagttattcggcgttaatcccttgatcagagtccaccatgacgcccttcgtttcatcaaacacgcaaatgttgccatagttttccttaaatcccatgtgattgcccccatcaatgaaataacgcggcgattcatgggggtactgaatgactttaaccggacatttcggatagtttccagttaagggagtttcgggaactggcggtttcgcatcgccggcatagtcaccgtagattaaggcagttggtgtatgtccggtaacaatggttttgttaagcggattgtgcgcaaagatgggatgctgacgcgtttgggtttgctgcatgtcataaatataaggctcccggacccacatgcggttaaacggtgtggtctcttttaaagggttctctaaggatagatctagtccggcgtgaatcagtaaaagcttgtcaaacgtcaccgctgtgggcatttcagcaatgaatgtaatcagaggcgcgatatgttgctgcaccgcctgccgtaaattggacttttgcgcgttggcagggacaaaatccttgatcatttggcgcaacgttactttaccgccattgatgaaccaaggattatctttgtccgccaaataatccagcaacatctgatcgtgattgccccgaactgcaattgcctgactattttggacctgttcgtgaatctgactcaaaacgcggccgccatacggatagccgtcaatgtagtccccgagatagacggtgagtgcatggggatacttggcttgcatcaagcgaacacgatccattgtttttaaattgccatgaatatcggatacaacaatcatggtcatcgcttttgcctcctcacgtctttgtcgtcacttttttgccagcggtggtttattcaacatgccgattcatacacctataaataacggttacgtctagtttactttatttttgcctgattgtgcgatattaataagaggttaggggtgaaaagatggataaacggttaattgtcatgcacaacttgagtcagcattacggcaaacagtattggtggcagcaaaactcactggaagattggttgatgatgatcctgatccagcgcaccagttctaagaatgtcgcgcaggcggtgcataatttgcggccttacatgcaggttgatcgcttgctggcgctaacacaaccggaactggaagcacttgtgcgaccggccggattttaccgccaaaaagctcagcgcattcatgatctattggtgtggtttgtggctcaaggcggcagttttgacaagattgcccaaaagccgacagccgaactgcgcaagactttactggcattaaacggtatcggcaatgaaacggccgatgtcatgttgatgtacacctttggcaagaaaacgtttgtcgcggatacttatgcgatgcgcttattcaatcgcttaggtttcggcccctataaaaattacgctaaaatgcaggccgattttaccccgctgttaacgggcatcagtttagatgatgcgcgggaatggcacgctctcatcgatgaacatggaaaaacgcaggtacgacatgcctatgatgatcattttttgcttcagcccaatttgcccgaagcagcctggccaccggaagcaaaacaaattgagcccccgcatgacgaccctggcagcggcaaatggcgcagaatgtcagagcagtctgacaagtaggcaagccgccaattttactgaataatgtcacggttaggatcgcgccagttaatgacaatgacgaggagcatgatgatgacgaccatgatgaaaacaccgtggaggccagtgagaatggcggcggcagcatgaggatcgtggacggtggttgctgagttggcgctgatcgctgcattgacggctttaaaggaagtgccatgcagattagcccggatcacaagcgttaacacagccccataaacccccgtcataatcgtttgtcccaacgatcgccctagagtcaagatgctagttgccgagccgacatagcggtcaggaaccaagtgttggctaagcaccgtgttcatactaatgacaatccccatcaccgttccgttaatcatcgcaatgacataaaaagcccaaaccgggaatgaggacgaagcaaatgtgagcagtaggtaggctaacgtcagaattgtgaccagacccagtgtcaaagtacgtggcaccatccgcttaatcaaagggtcaactaaaaacgacgaggttaaccacaatacggagctagaagtcacaaccaagcctgcagcggtggcgcctaaatgataaagcgattgtaaccagatcggaaaataaacctgataaccgattaagacgccactaagcagcaaagccgttaagatttggacggtaaaggtgaaccgatgaaacatctgcggcgcgattaaagggtcaacagcgcggtgttcttggcgaattaacagatacccgccgacaatggcaagaacgattaaaagtgcggctaaccacggctgctgatcaagtgcttgaatgcctaaaagcaaggcaaccaaagtgacagctaaccaagcgattccgagccaatcaatcgtaagcgacacatgttcccgccgcggttcccgatagccaacttgaattaagccaaagaccagaattcccagcggcacattcacaaagaacacccagtgccatgacaactgatccaccagaaagccaccgatcaaagggccaaccaaggcggaaagtccccaagccgtattgttaagtgccagcacattcgcgcggtgggcaaaatcgtaatagtccgcaatgatggtaaaagttaatggcatcaccgcaccagcgccaataccttgcaacgcgcgcgctaaaatgagcagtaaaatatgcggcgctaggccactgagcagcgtgccaagcgtaaacagcaccacaccccactgaaaaacgccacggcgcccaagcgtatcagccaacttgccataaattggggttgtaatggcagttgtgagtaagtaagcactcatgatccagctttgataagccagcccatgcaaatcactaataatcgcgggtaatgccgtcgtaacaatggtgacttcgaccgaggtcatgaaagtcgcaataaaaaccgccgccataacgaggccgcggccttgaggttttgtcgatgtagacatgtggccaaccatctccttaatagctctattgtaacaattaaggtcaagagctttgaatggttatagtttttcattctcaatgtaagagctacaagaaaatgtatccctgcaaccactagcaaagctatttagtggctacagggatacattgaatattgaatattaaatcgccggccgtcttggatgatgcggcgtttgagtttgatcaatgacgactgcacctagcatcaaaataataatgatgacagctgccattaattgcccaaagaccatcaaactaaaggcgccgatgaaggcaaaaatcaacaacaaccaatcaagctctgagaatgacaacccaatcatctccttaaaagtcagactccgaggcatcgtaactcattgccttgctcggcgacacatagacgacaagctcatcgctgaatcgcttgagacaataggcaatgatgccaatagcagcaagcgttgtgacagtcttaatcagcggctttttcatgctctcgctcctttgcttgcacattatatagaaggtattaaacacatcttaagtttacacccgctgcatgaagatagcagaagcgaggtggaaaaattgagctcatggttcgggatgcgccatgatcgggctagcaggcactgacggtaacaacatttaaggcaatttaagcgaatttaagtcaaaataagcgctttttgccaaaactgtggtatactgaaggcattaaaaccgaaagtaggtatgagcatggatacaaaagtaaagaccgttgattactcatccaaggaatactttgacaagatgaccgcttattggcgggcagctaactatgtgtcagttgggcagctttatttgaaggacaatcctttgttggaacgaccactgaaaagtgaagatgtgaagccacatccgatcggccactggggaacgattgctgggcaaaacttcatttatacgcacttgaatcgggttattaataagtacgatctcaatatgttctatattgaaggtccgggtcatggtggccaggtcatggtttccaactcctacctcgatggttcgtattcagagatttatccacgggtttctcaggataaagaagggatgaagaacctgttcacccaattttcctggccgggtggtgtggcatcgcatgcgagcgcccagacgccgggctcaattcatgaaggtggggagctaggttatgcgctgagccatgcaaccggggcgattttggataatcctgatgtgattgccgcggttgtcaccggtgatggcgaaacggaaacgggtccgttagccgcatcttggtttagtaataccttcattaatccaatcagcgacggagcaattttaccgatcgtgcatatgaacggcttcaagatttctaacccaacgattctgtctcggaaatcagatgaagatctgaccaagtactttgaaggcatgggttggaagccatactttgttgaaggcgatgacccaaccaagctcaatcctgagatggcaaaagttatggacgctgcgatcgaagaaatcaaagcgattcaaaagcatgcccgtgaaaccggcgatacgacaatgccgcattggccagtgattattttccgctcaccaaagggctggacgggtcctaagagctggaatggcgaaccaatcgaaggctcgttccgtgcgcatcagattccgattccggttgatgctgaagatatggaacatgccgattcgttggctggctggctgaagtcgtaccatccagaagaattattcgatgaaaatggcaagttgattccggaactggccgcgttaccgccaaagggtgacaaacggatggccgctaacccgatcaccaatggcgggcttgatcctaagccattagtattacctgattatcgcaagtatgcactggataataccgagcatggcaagcaaattaagcaggatatgattgtgtggtcagactatctgcgtgatttgatcaagctgaacccgcataatttccggatctttggccctgacgaaaccatgagcaaccggctttacagtctgtttgaagtcaccaaccgccagtggctggaaccaattaaggagccagctgatcaatacatggcaccggctggccggattattgattcgcagctgtcagaacaccaggcggaaggctttaatgaaggctatacgctgactggccggcatggtttgttcacaagctatgaagcattcctgcgcgtggttgattcgatgctcacccagcacttcaagtggattcgtaaggcccatgaggaaccatggcacaaggcttatccaagcttgaacgtggtttcgacttcgacgtccttccaacaggatcacaacggttacacccatcaggatccaggcattttgacccacatggcggagaagaaagccgaatacatccgcgaatatctgccagctgatgcgaatagtttattggccatttcaccaaaactattcagctcacaaaacacggttaatgtgctgattacttccaagcagccgcggccacagttctacagtattgatgaagcaactgttttggccaatgctggcttgaaacggattgattgggcttccaatgatgatggtgttgagccggatgttgtcattgctgctgccgggaccgagccaaacatggaaagccttgctgcaatcaacttgttgcatgacgccttcccagacttaaagattcgcttcattaacgtgcttgatcttttgaagctgcgcagtccagaaatcgatccgcgtgggttgagtgatgctgaattcaacagttacttcacgacggataagccggttctgtttgcctatcatggctttgaaggcttgatccgtgacatcttctttacccgtcagaatcgtaacgtcctgattcacggttatcgtgaagaaggcgatatcacaacgccatttgatatgcgggttctaaacgaacttgatcggttccacttggccaaggatatcattcagcatgtaccggcatatgctgaaaaagcggctgcctttgttcagaagatggatgatacgttgcaatatcaccacgacttcattcgggcaaacggcgaagatattcctgaagttcaggagtggacttggaagtcaattaagtaataccaatcgagtcttggtacaatcgctcagataattaacaaatcggtattagcaggtgaccgctaatgccgatttttattttgtgaaattaagtttagatgataactattttaatcgatataaatacgagtggcgatgtaaccgcatacgctcatggcgatgaaccggtttaagaaaaaatgtcaccgactgtcagccaaaaagtgaacaaaatatgaatactatggcaaaaattatgtaaaaaacacctttacatctcacgagttctaatatactcttaatgtattatcattttgagggtgagtagatgaaagctaaacgaatgatcgccggggcaatggtagttgcctcagcagttctcttggttgcatgtggcagcaagagcagcagtagcaccgaaacgtttaatcgaatggaaaaagatgtcatttcgaccatggataacgcgcatattacagatgttattagtggtcaggcagcggtcgatacgggcgatggtctctatcgttacaagggtaagaaattgcagccggctgtcgcaaccaaagtggtgaagccgactaataaggggcttacgtacacgtttaatctacgtaagaccaaatggagcaacggtgatcctgtcacggctaaagattttgtttttgcttggcgccgggcaaccgatcctaagactaagtcagagtatgcttatctgttctcgggtatcaagaacgctgacgatattactgccggtaagaaggcgccatcaacgttgggggtaaaagcggaaggcaactacaagctggtcgtaacgatggaacgtcccattccttatttcagtactatgatggttaacccagtcttcttcccgttgaatcaaaagacggttgaaaaatatggtaagaaattcggaacgcaaagcaagtatctggttttcaatggaccgtttaagctgactaactggaacggcacagggaattcatgggacgaagtgaagaataagtcgtattggaatgccaagcaagttaaactagacaagattcatgttcaggtggttaaagacgctaacactgcggctaacttgtttgcaactaagaaacttgacgatgctgttttaaccggtgaaatcgctaaacagcatgctaaagataaagattacgtgggcgacaaacagggtcggacctcttatcttgatatgaacgaagaaaaggttccggacttcaagaacctgaagttacggcaagcggtggcaatggctattaaccgtaaagagttcgctaataaggtgatcggtgacggctcatttgggatttcgacacttacgcctgaaaactctggctcaaatcctaagacgggtgaggacttcgccaaggaagcagctaaagaatctgaaacggttcagtcatacaacttgaaggaagccaagaaactttgggctgaagggctgaaagaagttggcaaatctggcgaacaagttacactgacgacagacgacacggatgttgctaagaagtcggctgaatatattcaatcagctttggaacagttacctggtatgaaggtttccatttcctccgttccattcaagactcggattcagcgttctttggatggcaccgcccagttcattctctccggctggcaaggcgatttcccggatccgatttccttcctggatctttatacaactggaaacacgtataacttcagccactggtctaacaagcaatatgatgagctgatcaaggcttctgagaccactgatgctaacaacgaaacaaaacgttacaatgatcttttgaaggcacaggaattactttctaaagaagccccagttgcgacactgtatcaaaccgttcaagggcatttacgcaatccgaagttgaagggcgttaccttcagcccagccaacatgtataactttgttggtgcgtatatggctaagtagtaaagattaaaattttcatttgaaagcccctgcttgcgttggcgtacttcaccaacgtaggcaggggctttttgtgtgagcttcagctagcagatattaaagagtttgtattgtggtatatattatataataatttcaaaaccgataattctacccaaggccggattaataatgatgtaagataagcacaacacacatatgttaatgaataatattttgataaaaataatctttaaataaaagtaaaaataacttaaaaatatattatagcttaataaatccgtatagaaataaatatttatttaaaaatggattgactagattggattttacaccgtataatttctatgtaatgttctagaaaagacagcacagggcagttaatgcttcacatgggcatcgctacgagttttatacgaacacaaggctggatatgtacaattgtgtgattgaagactgttgttctgggatttcaacaactgtttacatgcagagctggcgtaacggcaatgctaacggatggcggaaaccggatatttaatattttggaggttctatgatgtgccgctctttataagaatggagcggcctttttgggggttgatctctttgagaaataaacaatactggcagtcccgatcaaccatcacggctttgttactcgcagttttatttatttcgggccacctgattgcaaatgccggctatgatgcagatgggggaaagcatttgacgggtttctactttttttcgccatatatgaactggttgccaattgatatttcttcaagtttacctgttgcatggaatttggctgcgccgcttttatcagttcttgccggtggtatgatcgctgcttcccatgggcgcagtgggtatgccaagttaatgcgatttcggcacagctttgtggcttatcgcaggtcggttttcttggctgcgggcgttcttggtgcaattgtgccaatcatggtactgggtttagacttcctaggtttgcttgcgattcatcctaatgtgctgccgaatcaatggctcaataataatgttgcgattagttatttgggacttggggggaatcttttttatacccatacttgggcctacatgttgggatggattgctttgctagccttttacggggcaagctatgctattttttcgaattttctctattttgtcacagggaagatggtgctgtcgctgatgggggtcatgatggttcagttaatattattaagcatttctataatctttaagacgagtttagcgcctattacttatttacagattgttccaactattgggcaaccttcgctagtctacgttcttttatggcccgccattttaattgcaatgagtctttttagctttcgagtgccaaaaatcgaggcttagtttatgaaaataaggaaatatcagttgtttctacattttatttcacgctggcaaagcattttgtttttgatgacagtgcttgttttcgccctgactttcgttcttgccggaattatgacgggacggtttgagatcagccaattggatgccaacatttcggttcaacgtgcatttggacaggtgatattttatttgcccatcgttgggatgatgacgtttttacttgtgagtcaagctcaaaacacgagtcttctcataagaattggttccagaagtttgatagcaaaatatattttgcgagtgttattttatttggatcttgtgatatcggtggcggtctggatggtctggataactgcggtgcttttcttatcgcgaggtcaaggcggaatgacgtcggttgcggctaatgccaatttattgatgaatatctttaccgggctgtttttgtatacgctaatgatacttgctctttgtgtcgtttttaggtctagagcgattggtatttccttagggctgagtctgattatctgcttttatatcgttccttttgtcaatttaactgaagtcgcaaatctggtaaccccgaagttaactaaagatgcaatatggccgatcaatattgctaggcagtggttggcaatattcattggcgctcagataatcacgatattatttaaccatgttcgcttgcctgtcgaggggtgaaacttaatgaagatacaatggcaaaaaccgcttattgataagcgcatgatagtggttttactgcttgaggtcttactcttgataagctcgctagcgttgtattttgatcaacagaatagcaagttattacgacaagttcacgatccggtgatgactgtatttattggcgcaatgccggatcggtttgcgagcagtcagttgtggtggttgcttctgtgggttggattcatgtctttacccatcttcatttgtgccggggtgacagatgcttatcagcgtaatttgtatacgtttcttagcttgcggatgcatcgaagacttggtgcttatatctggcctttaaagcaagtggttttgagggaggcaagccttttattggtagtgggcattgcagtcggcacactgacacatttctttttgaggacgcagcaatttggcgaggctggcttgttcattattcttattattgtgagtcaaacgtttttagtggttttagaagcggttcttgaaggttactttggccccatgattggggttgtcggaacgttaacgatcatctttttaagttttctgcaaatgccgttgatgcctttgcgtttttccattggaagtacctttgcaacggattcacagttattaggtgcgattgggtatcagatcattttgatcattcttttgctactgattcaacttttttatatgccaggaaggtggggccgatatggcacaggtcgggaataaatcaggtgttcgtgttgatatttcacaaatgtccgtgatgatgagacggaaaaagattcttgatgatctttcactttcttttgtctctcctaatatttacggcattgttgggccaaacgggtcaggcaagacagtttttttaaaagcaatgttgggatttatacggcttgtcagcggtagtgtgacgatgaatgaggttccaattgatccgcggcgggcttttccgataagtgtcggcgctattattgagcatccgggttttatgaatgacatgagcgggcatgataacttattggctttgggacagattcgtagtcagcttgatgatgaagcgattcatgccgtgatgactcgagtcggactgccagatgacaaaaagccagtcgcaacctattcgctagggatgattcaacgtttgggaattgcccaagcgatcatggaagatcaggaatttattgtgttggatgaacctactaatgcactagatcgtgaaggtatcgtgtttttgactgaattattaaaggaacttcgcgaccaggggaaattagtgctgatcgcaactcacgaccttttgtggttgcaatcgctagcagatcagatatttgagttgtccaatggtaaacttcagcaggttgaggatgtggtttaatgatgaagtcggtgcatcggcgaatttactttttaatcggcggttgtgcaacagtgatgatacttcttgtagggctgtttgtttggcgctatcaaacccttaatgcgaatgttgcacagccggcagtttgtaggcgacggctgcggttgccggcaaaagtggttctgaatcagacaacggtcgtgctcgaaaagctggaaacaaaggtaacgaatgggcgttggcgggtgcgactgattttgaaacgcgcaattacgaaacaaaaccttcaacatatccgcattcaaatcgcccaacaccgcgaaggaagcgaagtagcgaatgaacaacttccggtaatgagccgggataagaaggtattgactttgacggatacctattatagtcaggcaaaatataatcgtgttgtcatgacgacattgccaagggttgcacgttcacaaaatctcgttcagattgtaacgttcaaggaatgagatcgtgttaacatagcttggtgactgaatgcggtttagaggagttgagcgctgtggttcaagaaatagacgacttgagatttcaactttcaccacatgctaaatttgatttccgtgctgccgttttactggtgcatgacaatcaagtgttagtaacggtgcagcctactagtggtgttgccattgtccccgggggtgcagtgaagtttggtgaaacttccggtgtagcagctaagcgtgagctatatgaagaattgcggcttcaggtcgatgagccgccactagtaggcgtacttgaatcattttggcaacagcctgatcgaacctatcaacaactgatcatggtgcatcgcttggtactgtcccaggcgcaaattgacgaactggtttggcaggaggggctgcaggggcagtggttgccgaagtcagaggtggctaaacacttgcaaccgcgcgctttgacacaatttttagaacctagtgcaacacttttgcaccttgtcgatcatcattcggaatgaaacttgagtgacttttcggcttgaaagcgcgcacacgagggcttaaattataaaatatataattagaggtgcttattttgcctttctttgtcaaccttgatacgcttaaggtaggctacagccggaagggagttgcatttttatggatataacgactagaccgacgttgcagcaatttttagcggataccaaacagggtccgtatgtatcactgtacatgtcttggccggagcatacaccggttgagaagttgcggatccggttcaagaatatgcttaaacatgtcaagacggtgatggcggaaacctattcggacaccgactttgcgccatatgctgccgaacttgaaccatatgagcaagatccgatgttttggcaagacagcgaagcaaacgggattggtatgttgacgaacggtgcgcaaacgtatgtaaccccaatgtatgaagcagttgatgaagtggcaatggtaactgaagtgccgcagattttgcctttgatgctggatgaggcaacggcaacagattttgatattctggcgcttaacgctgatagtattcagctataccataaccatggtcaccaagtgcgctcggtttccttaccagacgatgcgccacaaacattgaaaggcacacttggaacagaaattcgaggcggcgagttaaatagtgtgtctcaaggcggtggccacgtcacttaccatgggcacaacgaaaaatccgccgagaaggcaagcgatcaacggcgattctaccaggcagttgatcaatatttactgacaaattattcgaatcctaaaaaaatgccgctggttctcatgggcttagcagagaatgtagcggtattccgcgagatttccaagaaccatcatttactgccgaaacttgcagtggtcaaaagtccggcaacgcttgattttgttgagctggatgacttacttgaaccagtgcgcgccacattgcgtgatcggcgccgacaacacttcgctaatgtcattgaaaacgcacgcggcaatggcagttacaccgatgaattggcaacgattgtgtcggcggcattgcgtggacaaatcgccatcctctttgttcaagccggcgcacgcattcacgcgcggcttgaaggtgatcagattgagcgcgattccaaggccgctcagcatgcgaatctgttaaatacattggcggacattgtattaggccacggcggtcaggttgaacttttgcccgaagcccatttatcagctaaagtcggcgctacgatgcgttatgcttagtcaatgattgtgaacaaaaacgagctgccaagttggcggctcgttttttgttggaaaataggagaactgaatttttctcaactcaggttttttatgctaattcgagagttccggtcaactgagatttagtcttttcggtgagatgatgcgtaatcatgatgacagtaagctccttgttggctaataaagcatcttcaattgtctgggcattttcggtgtcgatcccagcggtcacctcgtcaacaattaggattggtttgtgaaatgctagtgcccgtgccaacgctagcttttgtcgttggccgcctgacaggttgctgccatgttcgtgaatgtttgtggttagattagcaaacttatcaattcctaggaaccttacaatgtttgttaatgcattcgtttgtttagcaacccctaatgtgatattttcctgaacgctttcgttaaagatataggacttctggtctaccagttcgatcttggcgtttaaagcggttgtcgccagcgatttcaattcggtgttatcgacatggattgcaccttgataatcacttagccttccactcataagattgataagtgttgatttcccaacaccactttttcccaagatggcatattttcctccgcgtttaaaagtgtaggaaacatctttaatgatgggcttttcgtcatagctaaacgagaggtgatccagggtaagcgcatggtcaaatgaccgatcttcggctaaacgtggtaactgacttaaatggctgttcttgtgaagtaagacgctgacggatttcatttgaaagattccttgcaccatgccagccaaattattgaatactgttcctgccaacgagccacttgccgaaatcaccccgacggagaaatagccaccgatgactaatagacaagttaaagccagaacgatcatttgggcagtgacattcacgccgctgatgagtaggttaacaagcccaacgtttctggcgtagcgaaccttttcttttccttggtaatcagaagcgtccgctagtttttgtgtgaatctgtcacctaagttatgactaaaaaatactgaaaaaccgccgatgatatcatctgacttctctaaaaaagaactattggcagaagcgatccggttcgtttcgtgtgtcataacttttgagaaaaattgtgggatggtcatggtgaggaggcccaggataatggcagcaaaggctagactgtaatggtagaaggccaaagaagtaatggcaaataaaagtgttgcagcattgcctagcaatgagaagaatgtttgtaaaccattttgttcgatcatgttgatatcattggtcaaccacgagacatattcattgtggttgaccttattatattcataaaccggaatactggtgagcccgttcgcgatatcggttcgaagttgattggtgactttgcgaatgatctgagctttcagcaacgaattgacataagcaatcgtcagcgtcacgccccaaattgaaatagttgccaataaccagaaaaccacaccccgaaaattcttgttaataagttgatcagtcagtggtgccaaggttaaagaacttgtaacctttccaagcgattcaatcaaaatcaaaagtgttgtcagtagcgtcagtagtttttgatgtgctaatagtttaattgttggtttcataagacatcagcctttctgataaagttgtgtattgcatcttagggcgatcgtggtatttgatagtgtaagtatatgtgctaatatgattttaattaaaaacgtttcatatatgaaaaagaggcagactgtgaaaaatattggggaagttattaataacttacgcgaacgtaaaggaatgagtcaggcagatcttagtactggaattctttcaaaagcacaactctctaagttcgaacgaaacctaacacaaatatcggctactaaattattagcattactggaacgtctccatgtcacgtttgctgagtttgggaatgcactggcgtttcaggaggctttgtatgagcagtcgatattagcggatattacaaaagcagttgttaacaacaatcgtgatcaagctgaattggtgcgggaacgcgcggcagaacattttacggcgtttccgggaaaatataatcaacttattttaatcatggttaatgctatgatcgctgatatgaccggtgaaacgctttcccaagcggatattgacgttttgacggactacctctttcatgtagatggttggacccggtttgaactgctactttttggtaatacgatatcagctttacctttgcgaactgtcaatcaactggcgcgtgaattggcggctcaagttaatgtggcttgggagattcaccaaaattttcagctgattatcaatttgttatacaacgttgtaatcgtaaacttgtctgctagagatctaacgacagcaagacactatttgcgagtgatgaaagatagtcatgttgaagatggcatgatggcagaacggtttctgattgcacttgctgaggcgctttgtatctactgtgaggacggtacggcggcgcacaaagatcaagtcgaaaaaattatcgccattcaaaaagaacttggtgcgacaaatttctttattgcatttaaaaatcaagctgaaatgttcataaatgaaactaagcaaaccgatgcttttccagctggatggcaaagttatatcttctaattcagatcggctagataaattgtcattgagctgacatgattaatcttcagcaaactggattaaatcagtcagatgtcaatgcacgaaaaagctcaggtcgtcctctggtgtgatgaggtaacctgaactttttggttgatattcaaatatcgcgataccagtgaatcacccaaaaatcactttgacaatttgttcagcggttttgaggctcacatcattgaccagtggccgcgggctggcagtggtgagccagtgaacgccttcagtcgggacgccccagaagaagaggccggcttgtggatgttctttttggtcaagtagctgttgggtttgacggtcaatggcaatagcgcctgactggaagcgtttgtcggcgttgagctgcagttcataagtgtgtgcgtacccgtcatgaagcagctgctgtactaatggattttgggcagtgggcgcattgactgccggaacgcgtgcttctagcaaggttttggcttgaagcgaaaattttggatcgctcggggtttttaaaagaaattggccgtcaatacctttgatctgcatgccgggcggtaaaatagtgacgataccggcacctattagtgcttgcagttggtcaatccgcaaagcaggcggtccgattgaaagaaaatcattcagtgagttaaaccagcgcaagaagaagtccaggtattgatcctgactgagaagattacgctcaacgagttggcgaatgggatcacgcatgtcgcgtaaaacttcaagcgcgctggtcagtggtccggttttggtgccgcgcatcgcttcttgggcatcctggcgcagataatgccgcatgaagtcttggtacggttggccgcttggatgcgccttggtgggatcagccaaagcatcccaatcgagacgatctttagcggcgattggcagtgctcccaaggtggcaacagggtcggcgataaaatcgcgttcaaaagctgcctcgtcaatttctgggtagcgttggggcaacaaaagccgatagtaaatcaactcggcttcgtgctttaaggcttcccagaaggtttgaccgctcacttcgccatgagtttgccaagcgtcaatttgttgtggtgtcaagaaatgcggctgccattcttcacccggtcccttttggttacggcctttagcacgataaggaaaaccgcggcgggagccggcaaaaatatgtggttcgcggccgctgggatgataaacaagcagaccgtctggcgctttttggaattgtccgccgcgaccttcagtgagacgactcatcaaatcaaagaaactcaagcccagtccgcgaataatgaccggcgattgtgcttcgatgccgctgagatcaccttcttcggggaaacccggttccaggtaaaagagctggtgtgtttgcgcataatcgtgcaatgccttttggtcgcgcgtcaatgagttttttagatttcccaaggccatgaccacttgatcggtttgccagctctcttggtcggtggtgacggtaaatccggcagcttttttatctagccggttcacggtttgctgcttataggtgatgatgttggtgccggcttggtatttttgcaagtcaaagaaccactgttggtagacgccgtacaacgcgcgggacgcatagctgttgggtcccagattggcagcctggcgcatcagaatcgaacggttgttaatttcggggtgagcatcgaggtaatcggcagcaagcgtgagcgcccaggtgcttaagtccggaccggcaataaacggtcccacgcctgtcactgtttgatcggtaaataaggtgatttgtgccgcagcagtattcataatgagattagggtcttgatcgatcttccaaacgcgaccgccaattggatacggatcaactaggaaaatggtgagttggcgctggggataacgggtccgttgccaactgataagccgacctaaaagcattaagccacgtggcccggcaccgataagcgtaatgtgcatgccgcatctgctcctttatgagatgataaattaagaagtaacaaatttattatacttggaagtgtccctaagcagttagcgacttgctttaggtttcaccgttttcgtgtcataatgtccttattaaccatctagaagggaaggcagatgctgatgaaagttgtcgttgtgggctgtacgcatgcaggaactgcggcagtgcgcgaactgttgatgaggcacccggaaacggaagtagatgtttttgaacgtcgtgaagacatctcttttctttcatgtggtattgccttgtaccttgaaggcacggtcgggcggttggaggacatgttttacgcaacgccggcctcactcgaagcattaggtcccaacgtgcatgttcacttaaaacatgacgtcttatccattgatggtgccggtcatgtgattgtggctgaagatttgaagacaggcacacaacagcattatccgtacgacaagctgattatgacaactggcagctatccggttattccaccggtttccggtgtgagtgttccgcgggtcttgatgtgtaaaagttatgatgatgcacgtagaatcaaggagagtgccaaagatgccgaaacgattgcaattgtcggtggcggctacattggcgttgaactggcagaggcttatagtcgtaatcaaaaacacgtgattttaattaatggagttgcgccgttgctgagccattatgtggatttaccgcttagtcgagaaatttcttcagtattaacggagcatggcgttgaattaaaagtcaacacggtggcacgccatttcgatagtgacgcggagcatgttttcattcagacggatcacggtgagattcaagctgatttggcagttgtctgcgttggttttcgtccgatgaccgagttgttggttggtcaggttaaaatgaatcatgatggctcaattcatgtgaatgattatatgcaaactagcgatcccgatatttttgcggcgggggatgcggttgcggtgcattttaatccgactggtaaagatgcgtatgcgccactggcaacgaatgcggtgcgtcaaggaaaaatggcaggtgcaaatatttttggcccaacgatcaagtatatgggcacacaggcaaccagtgcgttaagattgtatgatcatagtctggcggtcacggggctgacgcttgctcacgccaagcgcaatcaactgccggcagccagtgtgacgatggttgatgattttcgaccgccatttatgccgcacacggtgaagattaccatggtgctggtttatgataccagtaatcgtcaaatactaggcgcacagttttacagcaagtatgatgttgccaatgcggccaatttgatttcggtgatgattcaaaatcgtaataccattgatcagctggcctatgtcgatatgctctttaatccgaattatgataaaccgtggcattatctcaatttgttaggacaattggctgtagcacaagcagacaactcagcggtgtagggggaaaattatgaattcgtggaatcttatcggactgttcgcgtgggtgatcctgatcgcctacctattcttcatcatttggcatattcggcggcgacatattaaagctatcgtcaaatccgggcggcaggtttccccttccgtcgtgttggttgatctggtagaagtcgcggtgttgttgctagcggtcgccggaatggtatgggtgagttggttgcgtccgattgactaccgggatagccatgaggtgacgattagccacagtgcacaaccacttattttgcagaccggtgatgaacattccttttatgtacgggttcgcacgggaaatggtaagaatccgattttgtactatacttattggacagaaggcgccaagtatgaaaacacgagtcataacgcggaagtgagctccggcagccaaccactgacaccgcgagcggccgcatatccgtggtccaaaaaggaacttaaaaaactggatcaaagcgctgatcgtgcctatgtcgcaactgtatcggcgcagtataagcctggttttcttaacggcttaggcatgcatgtcggtcacagtgccgatcggttttcgattttacgggtgcctaatgatacatttgttgaaattgatccggttgaagattaaagcgcgttaactaaacaatttgaaagatcgctggtgggaaatgcggcatcagcgatcttttttcgattgacaagcttagaaaaaacgaagcagccgcgattctgcgtgtgctttttgacttagccgaatcgattagtccgcggtacatggtatgatgaaagcatttgaaatgagtaatataaaggtgcttgctgaccgcgctggctcgcgctcaccataacgcgctccccggcgcagaagtctgcgtgtaagaacctcagtcgcaatggccaagagcgggccatcacgcctgaggccgcttacactccgacttctaaccgcgccggctcgcgctcaccataacgcgctccccggcgcagggatctgcatgtaaggaccttggtcgcaatggccaagagcgggccatcacgcccaaggccacttacactccgatccctaaccgcgccggctcgcgctcagtttattaggaggtttgcagatgaatcatcgcagctggtggctgctgccgttgttgctgcttttgggctttggtcttgcggggctgcaaccggttcaagccgcttcaggtaaatggtatcgagataatggcaacatgatggggtctgaaagtaagacggttatcaaacagctgaacgaccaaacctttgccaaaataaccggtcatccccaaattgccgtgatcaccgtcacgtccttgcatgatgaagagattgaagactatgccaatgagcagtttgctaagcttggaattggcaaaaaaggttgggataacggccttttactggtgctttcacgccgagatcgtaaatattggctggaagtgggttatggactggaagatgtggtgccagatggcagtgccgatgagattgtcactggctcggtcaaaaaactgcttaaagcggaagactacgatcatgccattgcgttgtttttgacaaatatcggtaagcgggttgcggctcatcaaagcgccattgccacgccgacacagataaaagccaagcgcgcccatgatgccgccgtcaagcagcttttgataacggtggccttggtagtggtcggcatgatggtgctcttcttcatcattcatgctgccataaccgctcgcttacgtgatgcgatgccccatgtagctgctatgcagacgttaccgatctatgccgctgtgactgctgccgggattaaactgcaattagacacggcggcggttccgctatttcgcttcgcttggtcgcatgacaaattgcgcgtgatcgggatggcgaatttgacaaggcggggatttgaatcgtggacgcgaaaagtccgaatgatggtgccgcacccttattggtactatgacaacgttcgcggagcccttcgcaagttgccagatcagacactggtgaatgcgccgaccattgccgcggtggctgaattgttaaacccggcgctggcagatcggtttaaaaccggacaaccttacgaagcagctttcacggcctggttgaatgaacagaaaagtgttgccgggcaagcagcggtgacgacctggtctaagttcctggcaaaagttaaaccgactgataccttctcagatgcaacgctagccgccactttttccgctattcttttccatattcgccatcccgatcaagatcaggatttgagtcaatccgatgtgccattgtgggttatcagtgattttggctcggcgactagcagtcatagtggcgactccgatgactttggaagtggcttcggtggcggttctagtggcggcggtggttttggcggtagctggtaagctagacccgacccttgaaagtgacgcaacacgtaggctaacataaaaaatatatttaaaacgatgggtggcaggtagctaccgccattaaattcaaaaatgaggctagataaatggagcagatgctgttgttaatgggtaccggggtgctaggcggtattctgggagccgtgctgggaatcggcggcgggatgattattaccccgattttgacaatgttaatgggattgccgattcaatatgcgattggtgccagcattgtctcggtcattgcgaccagttcgggtgccactattgcttatctaaaagatgaaatgctgaatttacgggtggccatgtttttggaaattgcgacaacggttggggccgtcattggtgcggttatcactggcctggtgaatggcaaggtattgtatatcttatttggcgcattgttgatattttctgccttcaacatgattcgcaagctgcggatgaaagatgatggtgtgcgccaaacaacccctgatgcgatggccacaaaattacgcctgaatgggacgtattttgacaaggcaactggaaaagaagttaattatacggtaacgaatgttccaggcggttttgcgatgatgtttggtgccgggattgcatcagggctactgggtatcgggagtggcgcttttaaagtgattgccatggatacgattatgcatatgccgttgaagccatcgagtgcaaccagtaacctcatgatgggagttacggcggccgccagtgcaacagtttattattttggcggtcagcttcagccacaaattgccgcaccgcttgcgatcggaattctcgtcggtgcaacggtgggctcgcgggtgatgcaggttctgccaaataaagtcttgcggctgattttcattccggtgattgggtatatgggcatccagatggcacttaaaggatttggggtgaatatctgatggataagaaactcaaaaccgaaatcgatgatgttgaaatcatgattggtaaagtgatgcagattggggtcattttggcggcagtcgtgattatttttggcttgatactcttgttggtcagcggatcaaccggttatccggccggtgttcatccaacgcgaattggtgcgattataagcggcacggcggcactgaaaccttacgctatcctgatgacggggatctttttgctgattctgacgccggttttgcgcgtcgtggtatcaatctatgcgtttgcggttgaacacgatcacttgtacgtgtggattaccaccgccgttttgattatcctgctcggcgccatgacgattgggtatctgggcaaccgttaattaaaaaatagcgcttttgcaccgggttattgatccggtgcaaaagcgctattttgatacttcgtctggatgatgagtggcgtttagcacgcaattggtcatccttcgcggggcgccattacttaccacttggcttgtgttccatgtagtccttcagcgtggcaacgacggaagaatccggcatctcacgcatggatttaatattgtgaatatgttcaactgatacatggctgttaagcgccatctctgtgtccgttagatgatttttacgctggaagtcgataatttcccgtgaaaatgcactgatttgatctttttcagccaaaacgattcctcctcgtgaacctttactaacagtataacgatttttgtcattatgcgcacgtatgacatccaatcgtaactttaacaccattgatttgaaggttttcaagcatatcgtaacgatgactgaagaaaagtctaaaatctgcagatgccgtgttcgtcgactaaatacatgggtgaaacttaatgattgcaaagccgaacaagtgtttgtataataaagatgcactaaggaaatgggatcgcttcgttaattaagaaccgcatctgttagctgcaacgttggttagttgattaggagtgccaccatttaagcggatggtgtgtaagttcatatgcgtgatgatcgcgatcgtaaaatacacgccttgacccgatggcgacaatgtatgcttgcccggttacaagttgttgataaagctttcttttcttgacgagctggatacccttcaacaggactttgaggatgataaaccaaaagctgattaacaaaagccataaccacccattggatgttgagtgaaaagttgaggcttgcaaggttagcataagcggattccaaagcaaagcggtggcatcggtgattagctgatcaaataaagcagttggtgttgcaaacagagatatgagtgtgatgccaaagataaacaatccccaaagcatataaggtgccatgatcaacacggtaagcgcgcggagtaaggaatttggagtatgcaaaacgatagcctttcgaaaacgatgccatgcatagaacggatcttgatcggctatggttatcatctcccagttgttagtgaaacgatttcgtttaacaatctctttttcatacagatattgttttgatgttttccggacaaggtaatcgctagtcttagaatagcgcaatattgccttgatcgaaaggtaaggtgagcttatggaacactatgcctatttgcaggatctggcagccagtcaacgggatcgggaactgcgcgtgcggatttgggataataagaatatcattattcggcgaaacctcagccagcatcagggcttggctactcaggtctgggatgcatggttgcgtcaggagctgcgacgttttaacggttttgagccaattattgaagttgatgatttttccgggcatcaggaaattaagtttttcaaggaaaatgaattagcggatgccgttcatttcattcttcaaggcgaaggggcggttgaaacagctagctaactgtagccagattagctgggcgtgtaagcttttacatcctctatgttatcagtatactgaaggtaatgaggtgaggacgatgaaggcgattattttatatgcatcaatcacaggcaacgcgaaaggaatggctcggattgaacagcagttctttgagcattatggttgggatgtcacgcttggcgaaatgattcagacagatccggcaacgattaaagactttgacgtgttggtgctggcaacttatacctggactggcggcgtgatccctgaagagacccaagacttttatgatgacttaagtaagctggatttttcggctaagccattggtatttggagtgctgggtacgggtgatccctattatggcaaggattataataccgctccggaaaaatttgaagccgttttgaaagctagcggtgcagttcaaggcgcaaccgcggtcaagattgctttaaacgttaaacaagaagagatgcctcagtttgcgacatttacccagcatctgatcaaaaaaaccgaaacgctgcaaaacaagaagtgacccgttggcgcgtggtatactaaagccagaaagcgaggggatcttcatgagtgaggaaattgttttcttcaatcccggcgatgcagttgccaatgatttcgacttcgcagctgctcggcgtagtgcgcagatttacaaagcacagcatgtcgttgatgaaggcttggtagttgccaaagataaagacggcaagtattcggtcttttatgaggctgccggcacacctgattcgcaggctaaaggcgcatacaaagatgttggcaagtatacgatcctagctcacttatgacgaagacagtctggtatcgcgtggccttggtggtagttgctgtcattcttatcggagttctttatggtttaatgcagcaagaacaaatcgcgaatccttttttggttggcagtcttggcttaattctcggcgttgaccttgctttactgcttgccaatctttggcccgtacatcattcgcgcaagccttaaaataatcattcaaaaaatgccaatcaatccgcggccggaaaatttgcgccgtggcttggttggcatttttgcttcgttgaccggtaacttagtcgttgacaatatagcgcggctgcttgcctgacaaaatcgccaaagtgttatccgtaacaatttttgccatggcatcacgcgcctcgactgttgcgttcccgatatgcggggtcaaaaccacattatcaagggcctttagtcctgagctgacatggggttcggcttcgtagacatccagcgcagcaccagcgaggcgatgcgccgtgagttgttcaagtaaggcagcttcatcaatcaagggaccgcgtgcggcgttgatcagataagcactcggtttcatggttgccagtgcctgagcatccaacaaatggtgggtagccgggactaatggcaggtgaagggtgacaagatcgctttgttgcaagagtgtcgcctgatccgtaaaggtggcacctaggctttgctctttttccggtggcagttgatgatgctgcgtgtaaaggatgttcgcatcaaaagcatgaacacgtttggcaactgcctgaccgatctgccccataccgataatgcccacggttttgccggcgagttcatggcctaagaagaaggttggcgcccagccggagaacccgggaccgcgcatgagccgatcgccttctgtgacgcgatgtaaaacggcgagcattaaagctagcgtcacctcggcagttgacgtggttgatactttgggggtgttggtcacgaggacaccatgcgctttagcagcagtgatgtcgatattattgaaaccagcgccgtaatttgcgattagtttcaaatgaggcgcttttgccaatgttgcggcgcttaccggagtcgatagcgcggtgataagcacttttgcatcgcttaaatgtgcctggagctcggcttcggtaatcaagctcttaccgcgataggcttcaaagtccacgcctgcacgtttcaaagcgttgttggccgatttcggtaaggttgcagaaatataaacttgtgccatgaatatccacctttctgtggtcatccgtatctgactcacttttagtttaatacagcgcagagaaaaaagtgtgattgactcgtaacttcgagccaaagaataaccttgttaatatgaagcctgaaaaaaagaggcaagatatgacgtgcacgactcatttgtgttacactgtttttggtaacaaaaagtaagcaaaggggattgatcgttgatggcaactttaacgcaagatatgaaagatatgatcggtgcacagctgaactacttggcgacggctgatgaaaatggtaatccgcaagtcggccctaaaggtaccatgcgggttttggatgatcaccatttgatctataacgaagaaaccggcaagcaggcttggcataacttgcagtattcaaagaaagcagccgtagcaacggttgattacaaagctttgaagggcttccggtttgaaggcaccgttgaatttcacaacgatgatcaaatctttgaagacgcgcaggcttttgctaaggagcgtcatttacctgcagctatcagtgcggttgttatcaatgtcgatcgcatctataagctggatgccggtccaagtgccggtgatttgatcgaaggctaatgccgcgttgatgatatcggcgtgattttaggcttgtaaggcgatacggacaattccgttaatctttttaattagtaaattcataacccgccgttgtgacaaagtgcataacggcgggcttttttgtgtgttgaattaaatactaattgttattattagcatatttattgcgaatgatcaggccggttcgttaagcttaagatagtcagaaagatgtcaaccaaaagaaagggtgagaaccatgatgcatttaatttggacactgattattggtgcggtgattggttgtattggtcagctgatcgttggacgcgacatgccacttggctggatcggaaatattatcggtgggcttatcggtgcatggctcggcacggcgttacttggtagctggggaccatcactggctggtatggctttgattcctgccattatcggagctatcatcgtcgtcttccttgtttccttgttgctgggcacgactcggcgcaaggcataggaggcggcaggatatgaaaccgatcacgaaagtattgttcggtattgttgcgatttgcggcttacttcagagtattggctttggcctgttgctgtggcccaatcgcgaatttacgcgcttttacgtacagcaggccggttggttacgtcctgtgatgattggactaaccgggcttgtgattctggtttttgtcatcatgctgcttgtcgctatcttccgccgctccaccgccaatgctttgattctagccggtgacgatggtgatctgacacttgataaaagtgccatcgaaaatacggtagccaaagcgattgtcgaccggcattttgccaagtcggtggatgttgatgtcagcatccgcaagaagcaagtggcgcggatgcggattgaggccttttccggaaacgtcaaggaactaaaacaagaggcgcagcgtatcgaagaaactgcgcgccagaagttgcaagcgtgtctcggcgttccagtcaaacatgtccgggtacatttacttccagcaacgaaagtaaaagccaagactgcgcgggtcatttagttcaaacgactttgatcgatcactgaccgtcattcaaagcgggtggccgtaactggcaccggtggcagcagtggttatcagctacgaaagggtgatacacgatgcagcaaggaaccattggcgctgttgtcggcgtcatactagcctttgcctggatgcgtttcgggtttatgggcatgttgcttgtcttgatattcggcggtttaggctggctcgttgaacgttatctggtgcctaattgggcgacgttcacaagttggctgaccgcgggtaaagatgcatttagcaaaggaaagtaggtgagtagatggatgcagtagcaccgccaaaaccagcatcagttgcaagtcatcaggaaacactgatggccaacagtcgcttaacatttgaagataaggtcgtcgaaaagattgccgcaatttgtgcacaaaatgttgatggcattctagggatggatggttcggtgatggataacctgactgaaaccttctcaagtggcgagaacctgaccaaaggcatttccgctgaagtcggtgaaaaacaagtggcccttgatatggatgttttcctagaattcgacagcaacgcacaagccattttcaaacaattgtgtgagaaaatcagcgcgcaaattgaacgaatgacgggtttgcagttagtcgaattaaacatgcatgtcaaagatgttttgacgaagcgggaatggcaaaaacgctaatcggcgctaagggaccccataacgcgttcgccagcgcagggatcagcgtgtaaggacctcggttgcaatggtcaaagtgcgaccatcacgcccaaggccgcttacactccgatccttaaacgcgccggttcacactcattttaaaggagagattttaatggacaacaagaaacccaacggaatcaataaggaattgaagttcgatgatgctgtgatcgcaaaaatcgtcgggattacctgcaatgaagtcgaaggtgtttattcgcttgaaggcggcatgatggctaatcttacggatatgttcagcaaggatgaagacccgaccaaaggcgttaacgttgatttgagcgataaccaggacgtttcagtcacacttgatgcaacggtgcgctatggtgagaatgtgccggaaatcttcaacaaagtcaccatggcaattgccaaaaacgttcgccagatgaccggtctgaatgtgacagaagtgaaaatgaccgtcaagaacatgctgacaaaagaagaaattgcccgcaatgaagctaaaaacagtgacaagaacagcgacaaagaattacagccggcttaatgagtcaatatatataaaccggtaaaaagggatagcccatcatccatcgggggctatccctttttgacgttcaagaagcaattttttcgaccaacgcgggtagttctgtcagattcggcagggaataagtcggcgttatgtctggtagtggtgataattgctggcgattaatccatacgcaaggccagccgagtttatgacagggtacgatatcccaccaataccccattgccacgtggagatggggttggttgagtcgggtttcggccgtggtaaaaaaggacaaagtcggtttataacaatgcgtttgctccggtaaaatggcttgatcaacttggtgctccagctggtcaaagtggtgggtcattaaatccggggtggaattggacatgatgatgattcgatgaccggcttggcgcaattgctgcaatgcggggatgacttctggccatggttgtaagttaatataggactcaaataaatcatgaaaataatggctaaatagtgaattggtgtgaaaagtcatatcaagatattgcagatcgcgcttcaataaggtggtgaaaggcaaggtggtctcgccatacatgaggcgatcctcccacgattcgaattggtgccatgcagcctgaccgtcaataccatgacgagcactgaaggtcataaactgggttcgaatggggcgggtgtctagcaaagtaccatagcagtcaaatgtaatatccataaaatcacctttttgagtatcttagcatgatcaaggctgagaacaagtctttaaaaacaaaggtatcgatatattcggcagggtcggggtgtcttcatagccgagaccaatatagtgggttagataatggctgttcttaatagttgcatggcttaactaattgacattcctgccaataactattaaactttttaccaatatcaaagggggaacatcatggaatatttgaagctactcggcatcgtcatcattgttgttggctttgccttaaaatgggataccaccgcggttgttgtgctagcagcgattgtgacagccgtgttttctggtatgagcattccggatttgttgacgacactgggacaaagttttgtggataatcggatggtgtcgttgtttttcctgaccttaccaatgatcggactggttgagagtcatggcttgaaagaagtggccgttaatgggattcagaaactgaagaaattaacgccaagccgaattttgaatctttacttggtcattcgtgaattaggcggcgtctttgggatttccttgtccggccaggttcaatttgtgcggccgttgattacgccgatggttaccgccgcggcagaagcgaaacgtaagctgacggataaggaaatcgacttgattaaagcccgatctgccgccacggataatttcgggaacttttttgcacaaaacttgtttgtcgcaaccgctggcgttttgctgattgctagtacgatgaagagtctcaagcatccggtagagccgatgcaggtggtgctggcatcaattccgatcgcgattatcaccttggttgtagtggcggtttataatcgctggtttgatcgacaatttgaagaaacgccgcgcaaaggaggcaaaaagtgatggtcgacacgttactgctcattctttatgcactcatcggcgttgtcatggcgattgccgggattgaagccttccgtgcaaaagacaacccggctcgaatcggaaccggcctgttttggatcatcatggcgattgtttttgcgttcgggacgctattaccggcaatggtcgttggtattttggtcgttattatcggtattttggccttattcaagcagattcaaatcggcaagatcaagccggttgacggtgcgcatgcggctcaggcagccaagcgacttggcggctgggtgtttgttccaagcgttgtactggcgatcgtttcaattgccgttgcccagtttaccaagttaggtgggcaggtcgggatcggcattggcgcggcggtctcattgattgtggcgatcatcatgaccaaggcacccgtcaaaatgatttataatgatacccaacggatggtacgatcagtcggtgcagccggtattttaccgcagttattggcaacattaggcgctgttttcacagctgcaggggttggcactttaacggctaagttgattgcgggtctatttccggcaggcagtcatcttggcggggttattttgtactgtgtggcgatggcattattcacgatcatcatgggtaatgcgtttgctgcctttgccgtcattacggcggcgattgggattccatttgtgattgcccaaggtgctaatcctgcgatcgttgcggccattgggatgacttccggttattgcggcaccttattgacccctatggcagcgaatttcaatagtttaccggttgcgttgctggaaatggaagatccattgggcgtcattaagcagcaggcacccatcgcgatcctgcttttggtgattcaaatcggactgatgtatttcctggcgttttagaaaggacgattaagcatgaagattcttgtgacaggttttgatccttttggtgatgacaagattaatccggcgattgaagcggttaaacgtttgccagatgaaatcggcggggccaaaattgtgaagttagaaattcccactaaattcaatgtttcggcagaagtggtgcatgatgcgattgttaaagaaaagcctgattacgttctgagtattggtcaggctggcggacgttatgaactgacgccggagcgagtggccattaacttggatgacggccgcattaaagataacgctggctatcagccgttaaaccatacgatccatgaagacggcgaaaacgcctattttacgcaattaccaattaaagcgatggctaaggcaatcagagaagccggtgttcccgcggcggtttcaaatacagccggcacctatgtctgcaaccatattttctatcaagtgcagtacatgcgggacaaggaattcccaacgattaaagcgggcttcatgcatatcccgttcttgcctgaacaagttgttgcacggccagagactccggccttgtcgcttgaagatgacattaaaggcattaccgcagccattgccgccatcgtcgcacatgatggcaaaggcgaccttgaaaccgttgaaggcaaaaatcattaattgaagattcacgttgatattttccgcaagctcactagggcgtgcggattttttaatggccgatttttccgttttctccgggtgggcgatataataaaggcagagataaggacacggatacatcctcagtttggcaaagggaggttgtgacaacatgagtatcggaattattggatcaggtaatgttggacgcgcgttgggacagctttttagtcatgttggcgagcaagttattttgtcgcatcgacatggggtggcatcactggctccggtgattgcggagatgcgatcaacagttgaagcgggtacagttgccgaggcggccaatcaggatattgtcgttttggcagtaccgttcaatgcgttagacgagctgccggcgcaagtgaaagctgatgccgtggtgattgatgctacgaattattttcctagccgtgacggcgaacgagctgacttgacgagccatcaaatcgcttcatcgcaacttgtggcgcaacactttgggactaagaaagtcgtcaaggcgttcaatacgattgcgatgacgaaaattcgcagcctggctaagccgaatcaaccagccgggcggattgcgatccctattgccggggatgatgcaacggcgaaacaaacggtggccgcattgattgaaaagatcgggtttgatgttgttgatcttggtgatttggccaacagctacccggctcaagcagatggcccgttattcctgttcaccggtaatgctgatcaagttcgggcgcaggcaaataagtgactgcagcatggtagttcactttgcacacaggagaaaaaattgatgattttcttttatggtattttgttcatcatcgcggtgactttcttgtgggtgattagcaccaatgagtacgcgcaattggttcagaaaaaaagtcgcggccaagggcgtttgtttcggccttgttgctgggctggatgagtatttttgaaaagccgctcgctgcaattgaagacatgataatcaaaaatcggccttagtggagaaggtctctcacactaaggccgatttgtttggggttattttgttactggcattaacgctgtctctaattttgatatgtgctcattgtaccggctgaccgatacgctttttgtgatttgccacaatcattttggcaatggctttggcgatgttttggttcttaaggactggaccgtgtgaataactgccgatcgtattcttatagcgcatgccttcaacaccgtcttccggattgttaccgtagccttcgatcatctttcctagaggttttagcttatttttgtcgtcaaaataagttcggccgctatggttttcaaatgccttgacggtaccgaactcggtttcgtatttggtgtcgccgatcatacgactgtccggtttgaagacggtatgcagcggcaaaataccgagccctttaatgaccgtcccttcactagtcttgtaatagtcaccgagtagttggtagccgccacagatagccagcatcggtttgccattttcgatgtagcggcccaaggtttgggcatagcgcagtaaatccttggcgacaacggtttgttcataatcctgaccgccgccaaagaaaatgaagtcgtagtcatcggcattgaagtcgtcaccaagactgatgttatcgacttgtacttgatagccttgttgattcagcaagtaacgcagaattttaacatccccgctgtcgccataagtgttcatgagatcctcatacaaataagcgattttgatcgtatcagccatggaccgagcgcctccgtttttttgattggcaacagcttaccacaagtgaagggaaaaagagaagtgagctgattgattggtgctgaacaattaaagaaggcgggtaaagtatcagctggaacaacgccagactggtgctttatccgcacttagttgccctgccatatgaatagcaggatttaacgtttatgtgccttgatccaaggttgagccttttcctcaatcgcttgataaattgcatccatatccgagtagtcactgatctcaaacacgaattcatctggctgatcgtgaaaagtcggcttgttgtttaaaatgatgttcagctggtcaaattggttgtcaccagtatctttgcgaatttggtatgtgaaaaacgctgcttcataatcttgaatattgtcaggctcttcgtacaacacttccataaactggtggtcagtcttgtagttgtccttttttagcttatcccacagcgcctgatactgctgatgaagttcagttaactgagcatccgttaattgttcgttttctttaatttctttaccgtctaattccatttttttcgcctctgagttgaattacttccttattatcgaactgtgtggggggattgtcaaaagtaagcgcgagccggcgcggttagaagccggagcataagtggccttgggcgtgatggccgggctttggccattgcgtccaaggtccttatgtgcaggcttctgcgccggggagcgcgttatgggagtataggccaactctttctcaattctagtataattaagtgatttccgttactccgagctggctacgcggtggcaggctggcgaccgcgtagctaaagtggtgggcacgactttgaactcgcaaagtgcggttttcaaagctcggccttggtctaaagcggagaagcccactccgcttaagaccaatttcaccactgagtccgccaccgctccgccagttcttgctttccatccaattatccaaacaagatactcaacatttgtcaggtaatatccaagatggctcgacttctttaacgccagtgaaaactaattgtcttgtttcaagtcgacacttacctcactaagaatacagttgagcagacggcgcttttacgttacacttgacgggtacgtgaaaccctgtttgttccacaaaatcaaacccaaaaaaacggaggcagacatggatccaacagcttttgtccacgccttggctgatcacggtatcgtgttgaatgaccaccaacaggatcagtttgcggcttactatcagtatctgatcagtgagaacgagaaaatgaatctgactggtatcactgctgaaggggacgtctacctcaagcacttttatgattccctaacattaggcttggtggtgccaaaattgcaaagccagccattgtcgctgtgtgatgttggcgccggggcgggttttccatcaatccccttaaaaattgcgtttcctcagttgaagatcaccattgtcgattcgctgcagaagcggattggctttttggaacgtttaacggcgcggttagagttgaccgatgtgcagctctttcatgatcgggccgagacttttggtgccaaaaaatcgccgcaccgtggccagtatgatctggtgacagcacgcgcggtggcggcgctgaacgtcttagcagaactctgtttaccactcgccaagcagcacgggcagtttgtagcgatgaaggccgccgcaactcctgaagaattaatagcggccaaaccggcaatcaacctacttggcggtaaactcgttcaggatgcagcgctgaccttgccggaaaccggggatacgcgccatttgttagtgattgaaaaagttaaaccgacaccgaataaatatccccgaaaaccgggcatgccgaataaacaaccattgggaggtgcatagcgcgtggcattatcattttttggccataaaaagtcagatgacgagacggtcgtgcaacaattaccgcttaaagctattgtccccaatcaatttcagccgcgaaaagtttttacttccgaatccattcaggaattagctgctacgatcaaagaacacggcttgttgcagcccattattgtgcgtgaatacgcgccagatcagtacgaaattattgccggagaacgacgctaccgggcaatgcaactgctggggtgggaaaaagcaccagccattgtgcaaaagatggatgatgatgaaagtgcgtcaatggctttagttgaaaacctgcaacgtgaaggtttaagtgcgattgaagaaggacaggcttatgttgcgctgatgaaactgaatcacctaacccaaggcgcattagcccaacaattaggtaaaagtcaggcttttgttgccaataagatccggctgctgaagcttagtgcgccggtgcaagaagccattatgaatggtcaaatcagcgagcgtcatggccgtgagttgttaaaactcgatgaatccgaacaagtaccagccttacaacaggtttttgcggaaaaactgacagtcaaggaaacggctgcgttagtaaatgaacggttgcgcccaaagaagcccacaccaaagcctaagccaaaagttcggcgatcagcggtgagtcatgatacccgcatcgcttggaacacgttgaaacgttcggttaagatgattcgggatacgggaatgacagtcacggccaaagaagaagataccgatgacgcataccgtatgatcatcgagattccaaaagagaagagataggaggaactcatgacacatatcattgctgttgccaaccaaaaaggcggtgttgggaaaacaacaacgaccattaatctgggagcgtgtttggctaaccttggtaagaaaattctgattgtagatgctgatgctcaaggcaatgcgacgagcggtgtcgggattcaaaaggcccaagtcgaaaaagatatctatgacgtgttagtcaatgaggatccgattactgaagccattttaccgacaaagcacaagaatctttttattgttccggcaacgattcaattagcaggagcagaaatcgaattaaccagtcagatggcgcgggagatgcggctaaagttaggcttacacccggtggcggatcagtacgactatatcttgattgattgtccaccatctttaggccagctttccatcaacgcgtttactgcaagcgattcgattttgattccggtacaaagcgaatattacgcgttggaaggattgagccaactgcttaatacggtgcgccttgttcaaaagcatttcaatccaagcctggcaattgaaggcgttttgttaaccatgtatgatgcgcgaaccaatttaggggcgcaagtgattgatgaagtgcgcaaatattttggtgataaagtctatacaaccgtgattccgcggattacccggctggctgaagcgccaagttatggcctgccgatcgtggattttgatccgaaatcacggggatccgaagtttacgaggcattagccaaggaggtgctggctgctcatggcgaataagaatagtaaaggactaggtcgggggatcgatgcgatcttcaaggattttgaaagtcccgatctaagtgccaacaataccgttgaggaactgccgctggtcgatatccgtcccaatccctaccaaccgcgtaaaacctttgatcaggaaggcttaaaagaactagctgattcgatcaagcaaaccggggtttttcagccgattattgtgcgcaaaagtgtttcgggttacgaaatcatcacaggtgaacggcgctttcgggcgtcaaaactggccggcaaggaaaccattcccaccattgttcgcgattttaacgatccggaaatgatggaaattgccgtgttggaaaacctgcagcgagaagatttaaccccgttggatgaagcacaggcatatgatacgttgatcaaacgcttaaatctgacgcaagcagaggtctcagcccggctaggcaaaagtcggccctacatcgctaactatctgcggctgttgacgttgccacagccggttaagcagatgttgagcgccaatcagctgtcgatggggcaagcccgaacgctgctgagtcttaaagataagaccaagatggtggcagttgctaaaaagacaatcagcgaaaatctaacggttcgtcaacttgagcggctcattaatcaaatgaatgccggtaccaatcggccagcgaccaaggaaaaaccgaagtcgccgtatgtacgcgcaaccgaaaatcagttaggtgagcgcttcggaaccaaggtcaatattaatgaaggcagtaaaggcaagggcaagatcgaaattgattttagctctgaaaaagacctgaaccgtatcttagccatgcttgacgtcaatattgattaactggcaaaacagttggaggtgggcgcatgtatcaactacatgatctggtgcaaatgaagaaaccgcatgcgtgcggcacaaatcgttgggagatcatccgcttaggggcagatatcaaagtacgttgcaccggttgcggacatatcgtgatgatgtcgcgccgtgattttgagaagcgactcaaaaaagtgttgggtcaggcagaacaaacagactaaatagaaagtgtgaaataaccaaatggctttaacagcaggtattgtcggacttcccaatgttggcaagtccacgctttttaatgcaattactaaggcgggtgcggagatggcaaattatccgtttgccaccattgacccgaatgttgggatggttgaagtgccggataaccgactggcacgcatcgatgaactgattcccgctaaaaaaatcattcatacgacttttgaattcaccgatattgccggaattgtcaaaggtgcttctaaaggggaaggactgggcaacaagttcctggaaaatattcggcaagtggatgcgattgttcatgttgtccgtgcgtttgatgatgacaacattaccagcgtcaccggtaaagtcgatccgctagaagatatggccaccattaatatggaactggccattgcggatttggattcagttaacaaacgctatgccaaggtcgaaaaagtggcgcggacacaaacaaacgataaagaagctcaggctgagtttaaagtgttgcaaaaaatcaagccagtgctcgaaaacggcggcatggtacgcagcatcgactttgataaagacgagcaaaaaattgtcaaaggcctttttctgctcacgagtaagccagttttatatgtcgctaatattgccgaagaagcgatggctgatccggattcagtcgactatgttaagcaaattaaagccgaagccgctaaagaaggtgccgaagttatcgccatttccgccaagactgaagaagaaattgcggagttggacgatgacgaaaaagctgactttttggcagcggaaggcgtggatgaatctggcctcgataagctgatcaaagcgagctatcatcttttggggttggcgaccttctttacagccggtggcaaggagactcgtgcgtggacattccgtcgcggcatgaaggcgcctcaagtagccggtatcattcattcagacttcgagcgtgggtttattcgggcagaaaccatgtcttttgccgatttggataaatacggttccgttcaggcggttaaagaagccggacgttatcgctccgagggtaaagaatacgaagtgcaagatggggatatcattgaattccggttcaatgtttaagctgactggtcaaataaggcccgcagtgatgatgattttttaagataggagtttcaaatggcagaaaagcatgaagcagacacgagtcaagcggtagacagtgctgcagttgatcaacagcaagcagcaggcggtacttctgaagcttcgtccgcaaccgatgcggcaagtaagaatgcccatgttaaacaggtgcggccggcttcaacagttccggaaatgattgaacaactcaccaaaaagaatgatgagtacgtgttcaagttgcggcgtgaattgaaagatggcggcatgtctgcaactgatgaagagaccttacttaagacgatgttgccggaaatgattacggcgcaacgtcaaggcaagcccgctacccagctatacgggccggtaacggtgaaggcaaacgaaattttgcatacgcccaagcctgaacccaagaagccaatgtggttactgattgtcgatcaaagcctgttctttatggcgattttggcggttatgtacggtgctttggcctacttcaatcccaagacccagaacacggctactagcggttttcttagcctcttgctgctgagttttatggccggaattttcttcgtgtactacgccgactggatgcaaaaagacaagaaagaacgccgcagtgcctggttggttcttggaggcggcgtcttattggtcgttgcggttaccttcctcagcagtgcgcttgcgttgctcaatacgccgctgactcagccgatgccatggtttgccaacattatcgttggggttgttgcttacggcattcactgggtgttgcagcatcggtatcatctcaagagctttttccaacggtagacttgggaaatcaaaggttgtggttcttgaacaactaggctcaataaactcaacgggtgctagaagacaggatgcatatgtcttctagtgtccgttttttctttgctgccaaaggaaattaagcgtgagtagcttgaaaactaaacgcctcggagctaatgccgaataataacaggtgattttatgagcatgattgcaaaagacgaacattaatttcgcaaactggcaaccgtttttattttgttcgggtcttaatgaacaattatgagattttctttcatttttaagcctatgataccggtcttttcaaaaaaattaacgtctacgtttgacgaggccaatttccggtagtacattagtcaacaactaaaattgaaagagggatttacgcaatgagtaattgggatacaaagtttgcccggcgtggttttacatttgatgatgtgttgttgatacctgcagaaagtcatgttttgcctcacgatgtcgatctgtctgtacaacttgcggacaatctaaagttgaatatcccaatcatctcagcggggatggatacggtgaccgaaagtgccatggcaattgcaatggcgcgtcaaggcggtttaggtgttatccataagaacatgagcattgaggctcaggctgatgaagtgcttaaggttaagcgcagtgaaaacggggtcatcgttgatccgttcttcctcactgctgacaagccagttagtgatgcggaagcgttgatgaagaagtatcgcatcagcggcgttccgatcgttaataatacaaccgatcgtaaactgaccgggatcattacgaaccgtgacttgcggtatgttgatgataagagcgttctgatcgataccgtgatgaccaaggaaggtttggtcactgctccggctggcacttcaattgaagacgctgaagccatcctgcaagcccgtaagattgaaaagttaccactgattgataagcaaggccggctcagcggactcatcacgattaaggatatcgaaaaagtggtagaattcccgcatgccgctaaagatgcacatggtcggttgttagtcgctgccgcagtcggggttacctcggatacgtttgaacgggcccaggcgctgttggatgcaggggttgatgcgattgtcattgatactgctcacggtcatagcgccggtgttattcgtaagatcaaagaaattcgcgaacattttccattagcaaccttaattgccggaaatgttgcaacggcagaagcaacggaggcgttgtatgacgctggcgttgatgttgtgaaagtcggcatcggccctggttcgatttgcacgacccgaattgttgccggcgttggggttccccagttgaccgccgtttatgacgctgccagtgttgctcgcaagcgtggtaaaaccattattgccgatggtgggatcaagtattccggcgatattgtcaaagcgcttgctgccggtggtaacgccgtcatgcttggctcactcttggctggtaccgatgaagcaccaggccagtttgagatttatcaaggccggcgctttaagacgtatcgcggcatgggttccttgggcgcgatggcacaggctcatggatcaagtgatcgttacttccaaagcggtgtcaatgaagctaacaagctcgttcctgaagggattgaaggccgggttgcttacaaaggcagccttggcgatgtgatcttccagatgcttggcggcattgaatccggtatgggttatgttggcgcaccgaacttacaagaactacaggataatgcgcagttcattcaaattaccggcgccggattacgtgaaagccatccacatgacgtccaaatcacccgggaagcaccaaactactccgttcaataatcaagatattcagtttaagagcttgcagttacccacttgaggcagctgcaggctcttttttagtgagcgcgagccggcgcggttagcaatcggagtgtaagtggccttaagcgtgatggccgggctttggccattgcgcttaaggtccttacacgcagattgctgcgccggggagcgcgttatagaaagcgagcgtgaaccagcgcggttagggatcggagtgtaagtggcctcaggcgtgatggccggtctttggccattgcgcctgaggtccttacacgcagatccctgcgccggggagcgcgttatagaaagcgagcgtgaaccagcgcggttagggatcggagtgtaagtggcctcaggcgtgatggccggtctttggccattgcgcctgaggtccttacacgcagatccctgcgccggggagcgcgttatagaaagcgagcgtgaaccagcgcggttagcaatcggagtgtaagtggcctcaggcgtgaaggccggtctttggccattgcgcccaaggttcttacacgcagacttctgcgccggggagcgcgttatggtaatcgcgagcaagacagttttaacgtgcgagcttaccgtttttgataacgtgcccgatgaaaagcggtcagtatcggtgtgccaaaagtggtggctattgctaacggccaaggaacggggcgctccgtggtcgccaacaatgtttgcagccattgcgcagtcggcagtagttttatcaaccgatgactggaaaactgggtgaataacagattttcactataaaaatggatcagataccgctgtagaagcgggtcatggattggcaacagcagatcgttgctattattgcgattacccaaaaacagtggcagtcccgcgaagtcgcgttgtaaatcagatgtccggcttttatgagcactggccattgccggcgtgagtcgtaacatgaaaaccagtttatgtgctgctgcccacaacaacatattggcaatagcagcatcggttgccgtgaaattgaaagcaagctgctgtgctgcaggactggcgaatgcttggcgtagctgtgactggagctcagtagcggtttgtttatctgaataaagcacctgcagctgccgaacaccgcgcagccaatgaaggtgggttgccaagcgtagggtcagccattcgtcttggtggtgaagcagccaataggtactaccgcttgaatgggcaatgttaataccggcaatttgcatcgtttgcggcaaactggcagctacgagggttgttaattttggcaaaagaacacctcccacctgaaatgcaaagcacgcatggcgctcgttttcttagggttttcgtaaagaattcccggttcaattttggtacaatggacagtgatgttacagtccctaacgattgccgtataaatggagtcaaaattatgaagatattaattgtagacgatgataaagaaatcgtcgaactattgagcatttatgttaaaaacgaaggctatgaacctattcaagcatactcgggcaaagaagcgattaccaagcttgtgaccaatcccgatattgcgttaatgattttggatattatgatgccgaatatgtcaggcatggatgtggttaaggaagtacgcaaggattcgcaaattccgattatcattgtgtcagccaaaacagcagatatggataagattcaaggattgatcaccggtgctgacgattacgtcacgaagccatttaatccacttgaggtgatggcgcgagtcaagagtcttttgcgtcggagtcaaaatgaggtgaccaattcggagccggatgtgctggaagtcggtcctttgacgatcaaaaaggatagccacgaggtcacaactttgaccggcaaacagattcagttaacggctttggagtttggaattctctacttgcttgccagtcacccgaatcgcgtcttttccgctgacgagatttttgagcgggtttggcaacaggagtcaattgtatccgccaagaccgtgatggtgcatgtttcacacctgcgtgacaagattgaagaggcaacagatggtgagaaagtcatcgaaactgtctggggcgttggctacaaggtcgaggcctagttcatgagcgaaaaggtcaaactcactggtaaggaaaagtccgagttgtggattgaaggcattgtgacagttattttgttactgatgctgaactttgcgttgttagtgctgattaatcagatgattgcgcataatcccgggttggagaatgcaatctggggtgtgaagacgaatttgacttttggccgcggcggttttcatctgtggagctggtcgaatcttttccttaccttgatgggcattgcagacgtcattgtggtgtactggcgattggcacggcgatatcggcagatgcagatgcgccacgtgattgcagagttgcattatattgcggatggccacttggatcaccgaattaaatttgaggtgaataccgagctgcaaaaagtggttagcagcattaatgcgctggttgattctaccgtgaactctatggaagaggaacgacgaatcgaacagagtaaagatgagctgattaccaatgtcagtcatgatatccgcacaccgttgacctcgatcattggctacttaggcttgattgaggatcatcaataccgaagtgaagcagagctactcaagtacacgcacacagcgtatttgaaagcaaagcagatgaaggttttggttgaagatttgtttgagtataccaaggttaaatcaaccacgaccaagctgaatccggtccggttcaatatgattgcgatgttggaacagcttgccgcgagctttgagttggaagcccataagaaacacatgcggatcctggtcagcggcgaaccgaacccattaatgatggaagctgacactgaaaagctgggtcgcgttttcaataatctgatcgtcaatgcgttgaaatatgggcaaggcggacggcacattttccttgacgcccagcggattggcagcgaagtcgtcgtgaaggtttcaaatgatggggctcagattcccaacgatgccttaagccagttgtttgatcgcttttaccgggtagaagaaagccgctcccaagaaaccgggggcacaggactagggttggccattgcgcaaagcatcattgcgttgcatggcgggtatatttacgcagattcaagtcctgaattaaccagttttgtgattcatttaccattaaaagttggcgcttcgctgacggataaacaaactaaatctaatgaggaagcaggaaagacgaaatgaagaagttgttacgtgggttggttgccgcaatggtcgcggtattaatgataggcggtgctgctccagcggtgtccgttgcagctgccgaaagcagtgatacaaatctggttaatgccaaagccgcggttgcaattgagcccacaactggcaaggttttgtatgctaagaatgcaagcacggttttgccgattgcatccatgaccaagatgatcagtattgagttagttctcgatgccattaaatcaggcaagatcaagtgggacgacaaggtgacgttggatcagtcgatatggacaattagtcaagaccgtgatctcagcaatgtgccgctgcgacgtgatggctcatactcagtgcgcgagttatatgatgcctcgctcatctactcagccaatgcagccatgatgttgcttgcaaaggcagtagccggcagccaggagaagtttgttaatcaaatggatgccaagctcaagagctggggcattacagacgctaaaattgtcaatgtgacaggactgaataatagtcagctgaaagatgccaaagtaccaggtactggcgacaatgcggaaaacgaaatgtcagccaaagatatggcacaagtcgcgcaacacttaattaaggatcatccggaagttttaaaaacaaccagtattgccaggcagaccttccgtaaagggaccgatgatgcgatcaatatggaaaactgggattggatgctcaaaggtttggtttcctacgataagaacctgccagttgacgggctaaaaaccgggacttccgatgcggctggcgactgctttaccgggacggttgaaaagaatggcatgcggatcatcaccgtggtgttacacgcaaatggcgatgccaagacacggcggtttgatgaaaccaaaaagctgatgacccatgttctggaaaactggaagaccataacgcttgcgaatgccggccaaagtattaagggctacagtaaggtcaatgtcaaccgtggcgcatcacggacaacaccgattgcaccaagcgcaaaagccgttgccgttgttcccactgatgcaagtaaaaagacacttaagtatacttacacaccggctaagggtgtcaaaaagaacacaattgaagcccccgtcaagaaaggtaccacgatcggtaatttgaaggtaaccgcaaaagacgatcaacttggctttgtgggtgataacgcacaagaaggcattacccttaaaacgaccaagtccaatcagaaagctaatttctttgtcctgattttccgtggtattggtgatttcttcagtcacattttttagtcggtactgctgacatcatgaggtgaatgttttggactcccggttggaggtcaacgcgttcgccttttttgtgagcgcgagccagcccgtttagaaaccggagtgtaagtggccttagccgtgatggccgggctttggccattgcggctaaggtccttacacgcaggtttctgggctggggagcgcgttatggtaagctgagcgcgagccggcgcgcttagaagtcggagtgtaagtggcctcaaccgtgatggccgggctttggccattgcggctaaggtccttacacgcaggtttctgggctggcaatcgcgttatgatggaacaggatcacgaagcactgaatttcatgggaggcttgtaacatggtaacgtatcatgaaattaccccggctggtttggctaatcttaaacaagaagttgcggatctcaaggcgattcggccagctaagattaagaacctggctgaagcagcggctttgggcgatcgttcagagaatgcagaatacagcgccgctaaacgcgaattacggcagttagagggtcgcttgcgatatttggacaagttgattcggtatgccaaagtgacgacgccggccgcggccaaccttgctgatatcggtaattgggtgacacttgaatttgacgatgatcaggatgaagacacttatgagttggtcgggccagcagaagcggggatgggggcagctaaacttgccatcaactcaccactgggagcagccgttcgtcgccatcatgttggcgatacggtcaccgtcacggcaccgagtggcacttatcaggtaacggttatggccattagtccgcatgcgcccggtaagtcagtcgagcagcacgactgagcaaactcctcgatttatgggcggaaatttccaatgctgatgcgaggatcatggtagccgtaaccgaatgtcagaagagcaagcacctgaggcgtgtttttcatcatggtttcaaatagatcaagatgaaagctgccacagtgcttatgctataatgaagcttgaattcacggcatataaaaaggagtagcagcccaatggcactatcacttagagcttgtattttattattaaaggaacatcacttattaaaaagtgcggcaattcagaccactgaagatgtcgatatgaccggcattgcctatgattcacgaaaagtttccgggccgactttgtttttctgtaaaggagacaaatttcggccgatttatctgtccatggccaaagataacggcgccagaacctatgttgccgaaaagccttacgtggaaggtaatggtttaaatgccttaatcgtccggaacatcacgaaagcaatggcgattctcagtgcggcctttttcgattatccgcaagatgatttgtttgtgattgcttataccggtactaagggcaaaacaaccgccgcttatttcaccgaggcgattttgaatgaggctcggccacggcacatcgccttgttctccaccattgatacggtggttggtcccgagccggatcaacggttcaaatcgaacttaaccacaccggaaagtttagatttattccgggatatgcgcgaagcagttgaaaatggtatgacgcatttggtgatggaagtttccagtcaggcttatttacgtaatcgcgtctttgggctgacttatgatgtaggcttcttcttaaacattacccctgatcacatcggaccaaacgaacatccgacttttgccaattatctgcataataagctgcagttgttggtcaatgcgcgcaaagtagtgattaacgcggaaaccgagcattttgatcaggtctatgcggcagcgaccaccacgacttatccggagagtatttatttgttcgccagtgctggattcaagcctaagcgcgatgacattgatattgatttccgatttgatagtcaagaagctgatgtcgccgaaagccgctttacgttggtgccggtaacggaaaaagcagcggcgcttaatattggcggccattattcgcttgctttaatcggcgacttcaatgaaagtaatgcgacagcagcgattatcggcgccggcctggcaggtgtggatgcatctgctgcggtgcctggcatcgccaaagtcaaaattccgggacggatggaacattttcaggttccgggtcacggtacggtttatgtggattatgcccacaattatgctagtatgaaggctttgttatcgttcctgaaacgttcctacaaagatccgcgcttgctggtcgttgtcggctcccctggtgataaaggggtttcgcggcgcccgggctttgccaaagtattaactgagttggcaacagaagcctttttaacaacagatgatcccggctatgaggatccagccaatattatcaatgaaattgaccttaagattgatcacaccaaagttaaggttcacaaggtgcttgatcgtaaagaagcgatcacggaagcgattaaggctagtggtcccaaagatgttgtggttgttgccggtaaaggcgcagatccgtatcaaaaaattcggggcgtcaacacaccttggccgactgatatggccgttgtcaaggaagtcgcccaatcgttacaggaaggctgatttgaatgcgtcaatttttcaccgttattggtggcatggggacaccggcaaccgagagttatgtgcgtctgctgaatcaacgcacgcatgctcatagcgatcaggaatatctcaattatattttggtcaatgatgccacagtgccggatcgaaccgattatattctggatcacagtaaaccgagcttcttcccggatctactagaagacgttcgggcacaaagcctgttgcagcctgaattcatcgtaatcgtctgcaacacggcgcactacttttatgatcaattagctgctgcatcgtctgtgccactgttacacatgccgcggctggccattcgcgatatgtgcgagcgattcccgaatgaggagcggatcggtcttattgccacccaaggtacgatcaaagatggcatttacagtcatgaaatcgaaaatacagggcgcaaggttattttaggagatcaggcgttgcaggacatggtgacagagctcatttataagtacgtcaaagaaaagggcgaagtcaatgccgagttatatcatcgcatcttgaaacggatgcacgatgattttcaggttaacgtcattgttcttggctgcaccgagctttcgtttgctcaggaaaaagccggtgatcatccatatcatgtgattgatgcccaaagtattatcgtggacaagaccattgcactcggtaaggcttttcggaaaagtgaggcaacgggtaaggcattgctgaatcaaatgatggtgcgttagtgtgccggaaaaaggcgtcggaagtagctggttcatatcagtaacttccggcgcttttatgactataggcatcgagcgggtcatgcaaaataatacttacttgtggtaagctttaaatagtacccaataaaggagatggcatattttggcacatttaaccaaattaactgacacatataccttgagcaacgggggcaagattccaatcgttggttttggaacttggcagacaccggatggggaagttgccaagcatagtgtggaagctgcgttggctgccggttaccgtcacattgataccgcagctgcctatggtaacgaagaaagcgtgggtgccggaattaagacgtcgggcgttgcacgtgatcaaattttcttgaccacgaagctttggaatgctgatcacggttatgacgcaactaaggcagcgattgaccgttcgcttcaaaaattaggtgtagattacgttgatttatatttgattcactggccaaatccagttaagttccgtgacaattgggaagaggccaatgccggctcttggaaagcgatggaagaagcttataaagacggcaagttgcgggcgattggggtttcaaacttccgcgccaagcatttggatgcattgctgaaaaccgctaatgtcaagccgatggtgaaccagatcttcttaaatcctagtgatttgcagccggaagtggttgcttataatgatgcgcatgatattttgagtgaagcatacagtccactgggtacaggcaagattttccaagttgacgcacttaagaagattgccgcacggtataacaagagtgttgctcaagtcgttcttcgctggtcgctgcagcatggcttcctgccgctgccaaaatcggtacacgatgaccgcatcaaggaaaatacccagctctttgactttgagttgagtcatcatgatatgacgttaattgatgctttacatggtgaagctggtttagcgacagacccggacaccacgaatttctagcgttaagtcgtcaatcatgattttttgcgattaagtacacgacagctgtcaggtcgatgacaattaaataatccagcattaaaaaattcccgcaaacgctcattgcgggaatttttttgccaaataagtgcgtgcggctggcgatggcgaactgtattaaggtagggtcttagcgccggttttggcattgattagctggatgttgttctcggttaaaaattcgtggtacttggcggcgatatcgccataagtgacaatcgcatcgatatcttgcacggtaccatatgtgagcaacgatacccggccgaatttcgattgatcaatcaacagaattttgcgatgcgccttcttgaagatctccgacttaattaaatattcgttgtactccgagttggataatccgcgagtgagcgaaattccggttgctgccataaaggctttaccgatattgaaccggctgaaaatgttcatgttatcaatgccggtaaacgattgggtgcggcgatcaaagttcatgccgatgatgacaagcttaatattggcaagcggcgcggcttggttgatgatttgaagattgttggttaccaacgtaaaaggaaaatcggtcggcagaaattcgcccatctccgcagtcgttgtgccagagtcaataaaaattaagtcttcaggttcaatcaactgtgcggcagcccggccaatttgtcgtttttcgctgggtgcggctaattgacgctcgctgtaaacggtgagcggattgtcctttgtgctatcgggagtggttgtgaccccaccatagactttttttaccgtaccgtttgaaattaaggttgctaagtcacgccgcaaagtgcttggcgcaatcgagaacttatcttcgagctctttcattgacgcggttttaacttcgctgatataagcctgcatcgcatcaattcgttcttttctaagcatgaatgtcaccttctttaagccgtcttcgctaatctgattatagcacgttatgaatatattttggacatattatgaccatgttttaagctcgatgccgaagcatatagcagtaacctgatttccgtagactcgttgataagttggaacgtcatccaaagcgagtcatttggggagctcgtgaaaaaatagacatcactcgtgaggctagcaagtacctgactagttacttttatcatatcattttactacatgccacttcatttattttggcgaagtcgctcacaagtgaacatctaatgattaaattatgaacactttttagttgactttgaccatatctgcttatatgatgacaatgtaatcgaaaagtaagcgcttaaccgatacgtggaaagactcttgaaagtttggaggttaatagcatgcgtaaagcaggggttgttagtaacaaaggcgatgctgcactggctccccagccggatttgggggttaaatccgaaaaattgccaaaatcggctcgtcgtcgtttgcgggttatctcgattatcgcaacatttggcgggatgctttttggatatgacactggggttatcaacggcgcgttaccgtttatgaccagagcaggcgaactgaatatgtcgccttccatggagggcttagtggccagctcgttaacattgggggcggcctttggtgctgttttgaccgggcgcatttcggatcggcgtgggcggcacaaggtcattaccggacttgctatcttgttcgtcgtttcgaccatcgcctcagcattatcaccgaccgcaccaatcttggcgtccgtgcgcttcgtcttgggcttagcggtgggcggtgcttcggttattgtgccaacatttctagctgaagtcgcaccctcgaatcttcgcggacgaatcgtcacacaaaacgagttcatgattgtttctgggcagttgttggcgtttgtgtttaacgcgattttggggacaacgttaggtcatattcctggcatttggcggtggatgcttgttttggcaacggtgcccgcagttattttgtggattgggatgaattttgttccggaatcgccgcgctggttagccgctaatggcaaattggatcaggcgttaacggtgttgcggcaaattcggacagaagaccaagcgcaagacgaaatggaaaaaattcgaatttccttaaaatcggaacaagaagtgcaaagtgcctcgattaaggatttaaagattagatggattagacgacttgttttaatcggcattggcttggggattatgcagcagatcgtcggtatcaacgtcatgatgtattatggcaccacgatcttacagacaactggatttggccaaaatgccgctttgattgccaatattttaaacggtgtaacttcagtggtcgcaacgattgtgacgatgcatctcatgggtaagtacaaacgccggccaatgttgctgactgggattatggggaccttattctcgttgatcggcatcacgttgacgagtcattttctcgctggcagtccaatgctaccgtacttcacgatattattgaccgtcatctatctggctttcttccaaggagcattgggtccgctcacctggttactgctttccgaaatttatccagcacgtattcgtggcttaggtatgggttttgccaccttcttcttgtggatcggtaatttctttgttggatatttcttcccagttatgttggcaagtataggcatgtcgaacacgttccttgtatttgtcggagccaatattatttcactgatttttgcttggaagtttgcatcggaaacagcaggcagaacattggaggaaatcgaattggacaacaagtttgacgataagttccctgaaaagagcaagattaataagaattaagtttcctaagtcaatttatttgaaaatgtaagcgcttcataccattcttgaattggacaggagcgtgtgtaaacgggtgatggagccagcgtgaggactttggacgcaatgaccaaagggcggtcatcatgtctgaggccacttacactccggttcctaaccgcaccggctcacgctcataacgcgttcgccagcgcagaagtctgcgtgtaaggacctcagccgcaatggccaaagggcggccatcacgtttgaggccacttacactccgacttctaagcgcgctggctcacgctcactatacgaaaggggtttgttttcatgacaacgcaacaagcagttaagaccttgaagaattttattaatggtcaatgggttgatgctaagaccgatacttttgaagatgtttataatccggcgacgggtgaggttttggcacgggtgccgcattcgactagcgaggatgtggcagatgcagttgcagcggccaaagcagcgtttgaaacgtggaaacgggtgtcgattcctaaacgtgccaagattcttttcaaatatcaacaactgctggtggagcatcaagaagagttgggacgtattgtcacgcaggaaaatggtaagagtctcagtgaagcgattgccgaagttggccgcgggattgaaaatgttgagttcgcggcaggcgtgccgactctgatgatgggggattcgctctcggcggttgcgactgatgttgaggccacgaattatcgttatcccatcggtgttgttggcgggattaccccgtttaattttccaatgatggttccgtgttggatgttcccgatggcggttgcaacaggtaatacgtttgtgttgaaaccgtcagaaaagacaccgcttaccagccagcgtctggttgagttattccaagaagctggtctgcccgatggcgttttgaacatcgtcaacggggcggttgatgtcgtcaacggtctgttggatcatcccgatgtcaaggcaattagtttcgtgggatccgaacgagttggcgaatatgtctataagcgcggcagtgatcatttgaagcgcgtccaggcattaactggcgctaagaatcacacgatcgttttagccgatgctgatctcgatgctgcagttaaaggcattatcagttcgtcatttggatccgccggcgaacgctgcatggcgacgtcggttttggtgctggaagaaagtattgctgacaagtttatggcgaaatttacgcaggcagctaaagacatcaaaatcggtaatggtctggataaagatgttttccttggaccagtgattcgtcaggagaatcaggaacggacgttgaactatatcaagaccggggttaaggaaggcgccaagctggtcttagacgggtcagcagaagccgagaagcgtgatggttatttcgttgggccaactatttttgaagatgtcaaaaccgacatgaccatttggcacgatgagatgtttgccccggtactgtccgtgatgcgtgcaaaagatttaccggaagcggttgccattgccaatcagtccgaactagccaatggcgcttgcctgtttacggattcggccgcatctattcgctacttcagagaaaatattgatgcgggcatgctgggtattaacttgggcgttccggcaccgattgctgtcttcccattttctggctggaaacattcattctttggcaccttacacgctaacggcaaggatagtgtggacttctacacgcataagaaggttgtgacggcaagatatgaccagcatcgttttaattagaaattccagatgtttgacgaggaggcattaacgatgagcttgttgtatccaaagcaaaatcaggaaatacagccgggcgttcatttgattcaagacgtcaatgcaacgaattctcccatgaaatacaccgcagtgaaagtcttggagcttgatgcgcaacgttcatttgccgagactttaggtaacttcgaggccggtattgttattctggcgggtaaagtgaccgtcactgccggtgatcagcgttttgaaggtatcggtcaacggcaatcagtctttgacaaaattccgacagacagtgtttatgttggaacgggcttatcctttaagcttgccgcacaaactaccgcgaaggttctgattgcatactcgccgaccacgacttcatttccggttcggttgattaagggcgatattcatcaaatcgaacatcgcggcaggtatcaaaataagcgtctggttcaaaacatcttgccggatgatctcccatttgcggataagttattgctggtcgaggtttacacggactccggaaactggtccagttacccgccacatcgacatgatcacgataatttaccgacagaatcgctgttggaagaaatctattatcacgaaatgcagccgaagcaaggatttgtttttcagcgggtgtataccgatgacttatcgcttaacgagacgatggcagtgcaaaaccaagacgttgtgattgttcctaaaggctatcatcctgttggtgtgccggatgggtatgacagttattacctcaacattatggcgggaccgatacgagtttggcattttcacaatgcgccagaacatgcctggattattgatcgaaagtaatgaaaaaggatagctttgcagctaagttgacgagggggaacatttcaaatgtcacaaaaattcgatttgattgctattggtcgagcagcagttgatttaaatgcggttgaatataatcgacctttagaagaaactaagagctttgcaaaattcgttggcggatcgccggcaaatattgcaatcgggtcagccaaattaggccaaaaagtaggattcatcgggaaggtgtctgatgatcagctgggtcattatgtgacgcaatacatggcagacgttggcattgacacaacgcaaatggtcaaggatgatgcgggccacaaaattggcttaacgtttactgaaatcattagtcctgaagaaagcgatattttgatgtatcgaaatgaagccgccgatttatatctgacaacggctgatgtttcagaagaatatttagcgcaagccaagatgttggtgatttccgggaccggattagcccaaagcccgtcgcgagaggcgattttaaaggcactcacagttgcaaagtcacttggggttgaagtggtgtttgaactggattatcgcccgtatacctggaaaaatgccgaggaaacgagtctttattatcaattagttgcccagcgtgcagatgtgattattggcacgcgtgacgaatttgatgttctggaaaatcatcacggtaacacgaacgagcagacaattgcgacacttttcaaatatgatcctaagctaattgtcatcaaaagcggggttcaagggtcaaatgcgtatacaaaagccggcgatcattatcattttggagttttcaagacgaaggttcttaagagtttcggcgctggcgattcatttgctgccgggttcctatatgcttacagccacgacttgggaatagaaactgccttgaagtatggcagtgctgcagcgtctattgtgattagtcaattaagttcttcagaagcgatgccggatttggcgaaactcacggcatttattcacgaagcagagaggcaggaggtgcattaggatgagcgcaatggagttgaagtcgcaaggacgagaagcagagtcagccgcggcagatacagttcgattgacaaccgcgcaggccctcgtgcgctttttaaaccaacaatatcttgatgttgatggtgaggtcaccccgtttgtcgaagggatctttgcaatttttggccatggcaatgtactgggtttgggggaagccttgcaggaagacccggggcacttaaaggtttatcaagggcataacgaacaaggaatggccagcactgcgattgcctatagccgtcagttgtatcgccataagatttttgcggtgactgcttcggcaggtccgggttcggctaactttgtcacggcggcgggaaatgcatacgtgaacaacattccgattctctttttgcccgcggatacatttgccacacgtcaaccggatccggttttgcagcaaattgaagtggatagcagcgcaactactaccacgaacgatgcgttgaagccggtgtcgcggtactgggatcgcatcgaacggcctgagcagctgatgagcgcacttttaaaagcctttgaagtactgacaaatcctgaaacagcgggtccggtcacgattgcgttgccacaagataccgagggtgaagcttatgattatccgcgtagtttctttaataagcgcgtgcatgtgatcaagcggattcaaccgagcgcggcggaagtaacggaagcggttcaactcattaaggccagtcgctatcctgtcttaattgtgggtggtggcgccaagttcagtgaagccggttcggcaattgaagctttctcggataagctaaatattccgattgttgaaacaccaactggcaagtccactatttcggcaacgtttgccaataatatgggcggtaccgggattctaggaacagcagcggctaatgaagtggtcgcaaaagcggatctcattattggtgctggaactcgctatacagactttacaacagcttccaagacggctattcatccggagaaaacccgcgtgcttaacattaatttgaatcgcatgcagtcgtataagtttgacggctttccgattgtggcagatgtccgggatacactgacccaactgactagtgaattgtccggatatcaaagtgactttaccaacctcgcagacctcaaagctgcttggcaacaggaacggcagcgtttggcccatacaaactatgatgcgccagattatacgcctgaggttaagggtcaattcagtgcggcaacattagctgagtatgccgagaagttacaaacccatttcactcagacggaagcggttattgctgtgaatgacacgattgcgccggatagcattattgttgctgcagcgggatcgttgccaggggatgttcaacgaatctgggatccagttgtacccaatacctatcacatggaatatgggtattccatgatgggttacgaggttccggcagcattggggattaagttggcacaaccggataaagaaagttatgccttggttggtgacggcagcttcatcatgttgcattcagaacttgtcaccgcgctgcaatatcataagaagatcaacattttagtctttgataattccggatttgcttccatcaataacttacaaatggctcaaggcagcaacagctatcgaaccgaatttagaactgccgaccatgatattttaacaatcgattttgccaaaattgcggaaggatatggggctaaaacttatcacgtcaatgatcgtgacagtttagtcgctgccttggaggatgccaagaagcaaacagtttcgacattaattgatattaaagtgctgcctaaaacgatgacacaaggatacggccaaagttggtggcgagtgggggtttccgaggtatccgacaatccaaacgtccaaaaagcgtatcaagacattcagacaggtattgatcaggcatttaaatactgaggaaaacaacaatacaaaggagcgattgacatggttgtcaaagttggggttatcggtacgggcgcaatgggacgtgcacacattgatcggctaaccaatgttttaaccggagctgaagtcattgccgtcacggatattgatcaagaagctgcccaagccgctgttcgggactttaagcttaacgcaaaggtttatccggatgacacgagtttgttaaaggatccggacattgatgccgtttttgttgttagttttggcggtgcacatgaggcgactattctcaaagccttagacaccgataaattcattttcaccgaaaaaccgttggcaacgacccttgagggagctaaacggatcgtggataaggaaataggcaaaccgcgaaaagtcattcaagtaggctttatgcgccggtatgatgagggtatccatgccttgaagactaagctggattcgggcatcatcggaacgccgttggttgtgcgcgccagtcatattaatcctaatgttgcggccaattattccaatgaaatggccattacggatacattgattcatgaaatcgatgaaatgcattggttacttgatgatgattatgcatcgattcaaatcacctatccgcgccagtcaagtcaggtgaccaatgaagggttgcgggatccgcaattagccacattgaccaccaaaaaaggaacggtcattcaagtgttggttcatgtgacggcgcagtacggttatgaagtcaaactcgaagttgtcggcgaaaccggagaattaaagctaccggattacggattcgagccaatcgttcgcacccaagcaactcagcaaaccgctatggaaacaagttgggtaaaccgcttcttgcaagcgtacaacaccgaagttcaggaatttatcgatcacgtggctaaggatcagtcaccggtcggcccgagtgcttgggatgggtatgttgcagcggtgacggccgaggccgcgattcgttcgcaaaaggatcaagaaccggttttgatcaatgttgccgagacgccaacattttatcaaacgaatcaaccggtaaaggcttagccatctagtcaagcaatgtaaaaaagagggggaaaacgcgatggttcaaagggaagttaaaattggcattgtggggttaggacgacttggtaaaatccatgcaaccaatctagccacgaagattccacatgctaagttgcaagcggcaacgagtgtggtaccggaggagttagcctgggcacgtcaagaactcggagttgaagaaacctatgaagactttgatgacatggttcaacatgccgatattgacgctgtctttatcgtgtcaccgtctgggtttcatttgccgcaaatagaaagtgccatgcaagcaggcaagcatgttttcagtgaaaagccgattgggttagatctggatgccattaaacacactcaggcagtgattgccgatcacccggagttaaaattccaacttggatttatgcggcgctttgatgattcatatgtttatgccaagcaattagttgatgcaggcaaaattggtgatatcacgcttattcgcagttacagtattgaccctgcagccgggatggaaagttttgtcaagttcgcaacttcagccaatagcggtggcttgttcctggatatgtcgattcatgatattgacgttattcgctggttgaccggtaaggaaattgataaagtctgggctatcggcttaaatcgcgcctatccggttttggatcaggcaggcgagcttgagacaggtgctgcactgatgcaacttgaggataagacgatggcgatcttagtagccggacgcaacgctgctcatggctatcatgtcgaaacggagattatcggaaccaagggcatgctgcgggttgcgcaagtgcctgagaagaatctggtgacggtcatgaatgaagaaggcatcattcggccaacctcacaaaacttcccagagcgttttgcccaggcattcttaagtgaagaacaggcttttgtcgacagtattttgactggtgagacagtcggcattacggcggaagatggccttcaagggaccaaagccgcgctggcactgcaacgcgcgtacgaaaagaacgatattgtcaaggttaccgatgttgataaaaaggtaggtgcttaaagtgacgattgcattaggaattgccccgattggctggacgaatgatgacatgcccgacttgggcaaagaagtgacgttcgaacaggccattgatgagatggcgctggcagggtatcaaggaacggaagtcgggaataaatatcctaaagatccagtggttttaaagcattacttggatctgcgacatctgaaaattgctagtgcctggtttagcgcctttttaacgaccaagccctatgaagaaaccgaagcagcgtttatcaagcatcgtgattttctacacgccatgggggccaaggtaatcgtggtagcagaacaaggccatagtgttcaaggcatgttggataagtcggtctttgatgataaaccgcattttaccgatgaagagtggcaacgcttggccactggtttggaacggttgggggatcgcgcccatgaagtcgggatgcagattgtttaccatcatcatatgggtaccggggttcaaacaacggcagaaattgataaattaatggccatgacagatccggataaagtgtctcttttgtttgataccggacatttggtgttatccggtgaggacccattaacaatttttgatcgctactatgatcggattaagcatattcacttcaaggatgttcgtcctgaacaagcccagcaagaacgtactgaccacttaagcttccttcaaggcgttaaaaatggcatgtttaccgtgcctggcgatggcatgattgacttcaagccgatttgggaagccattcaaaagcaacactatgacggctggattgtggttgaagctgaacaagatccagcaaaagcaaatccatttgaatatgcgctaaaggctaagcattatctagatacgatcatgacgattccccaagcagtttaagggttctgtttgagaagggatatggttttatggcgttgataccggcaacaaaactgattcaagctgcactggcagatcacgcagcaatcggtcactttaatattaatggtgccgattggttggaaacgtatcttaaagttgcgcagaaaaccggaacgccgattattgttgctacctctgatcgaattattgattttcttggcggattcgatttcattgccggctatgtacgctttatggtgcaggcattgcacatcaccgcaccggtcgtattgcatctggaccacggcttgtcagttgaacatgtttatcaggctattgatgcgggatatacctctgttatgtttgatggctctaagctgcccattgaagaaaacgtggctttaaccgacgaagtagttcgttatgcgcaccagcatcatgtttcggttgaagcagaagtcggcagtgtcggtggcaatgaaaatggcttaatcaatggcatccgttatgctagtgtcaccgatgccgttaaaatggccgcaaccgggatcgatgccctagctgcagcattgggatcggttcatggcgattatgtgggccgtccgaatctgaactttgaacggatggctgctattgccgccgctaccaagttaccactcgttttgcatggtgcatctggcattcctgatgatcagattcaacaggcgatccaaaccggaacggctaagatcaatatcaatacagaagtgaacacggtgtggactgcagctatcacaaaagcggtgcaagccaaacgttccggtcatgatccgcaaccgattcttttggcaggcaaaaaggcgattgcgcaattagttgaaaccaaaatgaaggcatttcatattcttggaaagagtaaacgctcagtgacctttgaataattgtccggtcacatggcgattgaattggctcatgtcggtcatagtctaataagaatactgattgtcagttaccgctgcgtatgaggagggggaacgatgccattagttcgatttgacatgttaaaagggcggtcacccgagactattaaagctattttgcaaatcacccatgaagtgatggttgcagcgtttgaggtacccgagcgtgatcgttatcaaattgtccaccaacatgagccatatgaaatggtggttgaggataccgggttgggcataccacgaacggatcaggtggttgtgatttcgttagtgagtcgcgttcgtacggttcaccaattagagcagttttatgaaagtttggcaaggcgcttatccgaagcgggattagtggataagaacgatctcatggtcaatgtttcgtttaatcatgatcaaggctggagttttggtcaaggcaaagcccaatttttggatggcagtttataaagagaatatcaagtaaagcaggatgccttggccgcttctggaactttgccagaggaatcgaccaaggtatttttgtgaacgcgagtcggtgtggtcagaaacgggagcatagaggcgtttggtcatggtgctcaaagttcgtatatgtgcaggttgctgcaccgaggcgtctgtatcggtggcgggcaactgctttagttgacgccataattgcgatcacactaagtcgcagattgtttgggtaggcgaagagaagtgggggagtcgtgatggggatagaactgacacaaatggctttgaatcgaaaaattgctcagaagcggccactggaaaacttttttcaattagccgaagctgctggcattcatcaagtcgagttacgcaatgatatgaccacttctgatggctcagagactgtcattgatggcatgcaggttgcagaatttcagacgttaaagcaaaaatacgacctgcagattttaacgattaatgcgattcagcaattcaataatccagccaaattaaacaaaaatcgcgatcttttgaccaaactggcggaattgtcggcgcaaattggcaatcaggcgattatctttgtaccggaagttaacgcacaggacaagcgaaccgagcaacagcgacttgatgatgccgttagcagtttacaggtgtttggggacattctgtctgcttatcatttgacgggattcattgaaccgttgggctttagggccagcacaatgcggtatccgtggacagcgctggacgccattaatttatctggccggaccgagtttaagctgacgattgatacgtttcatttcttcttggcacatctaacagccgaacaattcaaagcaggtgttgatattaaccgcgttggattaattcatctgtcgggaattgagccgatccacgcattgcgagaagttgtggatgaagatcggattctgattaccgagcgggatatcatgcaaaacattgagcaggttcatttgtttgaggcaatgggttatcggggccattattcatttgagccattttcaagccggttggcagccgaaaccaaccagcaacttactcagcagatattagcaagtattgaacggttgaatcagccaactgcagtgtttagtacggaggtgacgcaaccatgaagttagcctatgatccttctatgttccgcgactcaatgaccttgaagcaaatgtttgatgaggttgcgcggttagggtatgagtatgttgaattgtcgccacgccgcgattttatttggttctatgagcacccagtagctgatcacacgctaattaagcaagtaaaaaagtacgctaaggatgccggcgtaaaaatttcgtcgatactgccggtacagcaatggtcttctcctgatgaacaggagcgcgagtttgcggttcgcaatttgaaacgtacgattgaaattaccgcagagcttgaggtgccggttttgaatactgaatttgctggcgataagtttcagccgcttgtttctcagggacagtggtataagtctatggcagaattagcgccggtgtttgaaaaaaataatatcgagctggaaattcaaccgcatcccaatgacttcatcgaatctaatcttgctgccacacgcttgattcgttcgttggatttggattgggtgcatcaggtttggtgtagcgcgcacgcattttatatggacgacgggcgtggagatattcgtcagcagtttgctgagtcgggggagcggattacccatgttttaatcgcggatacatttaaccacaaaggtaattttggcttgcggtatatcatcaatccgcctggggctccggtaacgattcaccaacacttgaacccaggggaaggagaagtcgattttacaacgctttatcaggtgttgaatgagcgccattttgacgggatcatcaccaacaatgtgtttgcgtggcctgatcgcgttgattggtcaaatgacgtcaccttacaatcaattcagtctggtttgcatttgttgaaaacgtgacaagccagttgcggtaattgaatcagatttagcttttttctgaaaaacggcacctcgaaaaagaaatccgagctgccgtttttgtatacttggaatggcgtctttgggtaatacgatgtgtcctattgttactgccgggttgcgtcaatagtggatctgacgcgacggaaaagcggtgcagtttgactgttggtttgaatcgcgctgatcatgaacaaagtgtccataagactgagctcagcgatcaaggcgtgaagggcttcggtgcgatagcgggattcttcagccacggcaacaaaggcagcatcggccattttggctaagtgtgagccgggagcgccggtgatgacgattaagggtacgttttgcttttttgccagttcggccaaagcaattgcatctttgtctttgccggagtgggaagtcaaaatcatcgcatcggcaacagtaagatgtgttgcagccatcagttgcatatggtaatccgccgcgtaaacgaccggaatagcggttcgtaaaaacttgtgataaccatccaaggccacgagattgctggcgcccaatccaaaaaggcctaactgatttgcatgggtgatccagtcgaccgctttggttaaagcagccgagtctaaatttgtcagcgtggtacgtaatgcatctatattggaggtgaagatcttatgagccagcgtttcgaccgaatcagcgggactaagctcagcaaacagcgtgtgatctggttcaggtgttgattggaccagtgccattttcaaggcttgaaaacttggataccctagggccttggcaaaacgcgaaattgtggccgtactgacaccggtgatggcgcttagttccgcaatattcgcgtggctcgcacgatcagggtgctgctgcaaataatcagccagttttttttcttggcgacttagattcggtttataaatctgcaattggaccagaaagtcgtgcatgttgccccctccatttcaagattattatagcatcattcgtttgaattgaaaattatttacgaacaaattgcttgatttttgtaattattttacatacaatggcaccgtaatcaagaaagatggcttccaggaagaatgattcgttgttgctatctaagatgaatcggcggtgtcttgaagatgcacagaagttaaataatggtagattcattggtgcagaaattgattgatgctcgcgtggtagccacgccggctcacgcgcacgcacaggaggttgcaaacatgcaagtaggtatggttggtttaggcaaaatgggaatgaatctggttgcaaatatgcgcgatcatgatattgaggttgtggcgtttgatttgaatgatcaggcgcgcacggaagttggtaagtatcaggttaaggcggttgcaagtctggatgccttggtaatgagcttggcctcaccgcggattatttggagtatggtaccagctggcaaaccaaccgcggcaacgattcagcagctggctaagctactgagtcccggcgatgtggtcattgatggcgggaattcttattatcaggattcaattgcgcatggtaagttgttagcggcggaaggcattcactttttcgatgtcggcacttcaggcggcatggctggagcccgcgcaaatggtaacttcatgatcggtggtgatgaagaacagtttgctcagatcgagccgctttttaaagccatcgcagctccaggcgggtatctctacaccggtccggttggctcaggtcattatttgaaaatggtacataacgggattgaatatggaatgatgcaggcaatcggcgaaggctttgatgtcttagcccacagtccctatgcctatgacaatgcggcggttgccaaaatgtggaatcatggttccgtgattcgcagctggttgatggaactggccggtgacgcctttagtgaagatgctgacttggcgaaaattcaagggattatgcatagttccggtgaaggtgcctggacagttgaagaagcgttacgtttgcacgttgccacgccggttattgccagcgcgctcatgatgcgttatcgatcggaagaggccgatacaatgaccggtaaagtcgtagccgcattgcgtaatcaatttggtgggcatgcagttgatctcacaactcaacgtcactgagccgatctatgcgttatggtgctggatgagagcaacgttttggagaatggacggctacgatcattgccgctgaaacttcatgtcgcgaaaacggatcaggtaaaagttgttcgaagtgatttcagcatgtgacgctggcggatacagattgaaaaaggagaagatgatgatgacggtcaaatacatgatcggggttgatttaggcaccaccagcactaaagttgttttatttgatctaaaaggcaacgccattgcgactgctaataacccatatccgttgtatcaggatacgccggacatggcggaggaagacccagaagaaatttttgccgcaacggttggtggtttaaccgaggtcatgcatcgtggcaatgttcaacctggcgaactaggtggtgtctcattttctgcggccatgcatagtttaatcttgatggatgaacatgataagccgatgacgcgggtcattacctgggcggataatcgggctgcggcgtatgcgaccaaactgaaacaaagtgatttagggatgacgttgtttaaggctaccggcgtaccgactcacccgatgtcgccgttggttaagttattgtggttgaatgatgcgcatccggagttaatggcgcgggcgacccattttattggcattaaagattatattttattccgtttctttggccgctatgttcaggattactcgcttgctaatgcgactgggctgtttaatattcacacgatggactgggacgatcaggcgttgagtgttgccaaagttcgccgcgatcagttgcctgagcttgtggataccagctatcaactaaccggtttgaatgccaattatgctgcggtgaccggtattgacgatcagacgccgtttattctcggcgcgagtgatggtaccttgagcaatctgggtgtaggggccattgatccaggtgtccttgcagtgacgattgggacctcaggcgcagtgcgggttgtgacggacaaacctgttgtcgatccacaagggcgtttgttcacgtattacctcgcgcctaatcagtgggtcgttgggggtcccgttaataatggtgggattgtatttcgatgggttcgcgatcaactttttgctccggaaaagttgaccgccgaacaattgaaggttgattcttatgagatcttgacggaaatcgcgagcaagattcctgccggggcagatggcttattattccacccgtaccttggcggcgaacgtgcaccgatttgggatgcaaacgcccgcgggagcttcttcggcttaacccgtcagcatacgcgcgcacacatggttcgggcagcactggaaggcattgtttataacctgtatatggtcatgctcatgattgaaggtatcaccggaaaaccccgggcaattcaggcaactggcgggtttgcccgcagcgcgttgtggcgccaaatgcttgccgatgtctttgagcaggaagtcaatattccggaaagtttcgaaagctcagcgctaggggcggtcgtcatcgggatgatgtcattgggtttgattgatgatcttagtgcggttaaggatatgatcggggtgacgaatacccatgaacctaacgaagcgaatttcgcggcttatcgagcgttattgccaatttggattcgtttgacacgcaaattgggtagtgaatatcaagccattgcggattatcagcgggcgcatcctgatccggcggcacgcaatcaggcgcaggattaggctttaagtttaaagagtggacagtttgtgtttatgtcttgcaattattaggtgaccggttttaaagcactaactgatgaacggttaggtcgacagacgcattttgagtttagacgcggctgccgttttttataaacgatattgtaagcggtttctgttgccgggatgcgagattttggttggctcgcgctcataacgcgctccccggcgcaaaagtctgcgtgtaaggacctcaggcacaatggccaaagcccggccatcacgcctgaggccacttacactccgacttctaaccgcgccggcttgcgcttactaaatcctgaggaggaaattaaatggacttacttgtcttgatactaggtattttgttgttattggtactcatcatcaaatttaagtttaatacgtatgtttccctgattattactgcagttgttgtcgcgcttggtttggggatggcgccggctaagattgctacgagtatacaaacaggcattgggtcacagcttggcgagttggcacttgtctttgggtttggggcaatgcttggtcggttggtggctgatgctgggggtgcgtatcggattgcccataccctgattaacgcatttggtcggcggggtttacagctggctgttgttttggcgtcattcattatcgggatcgcgttattctttgaagtggggattgtcttgttggtgccgatcgtgtttgcgattgcggctgaagcaggggtcccgattctgacacttggcattccgatggcggcggcgttatcggttacccacggattcttgccgccacacccagcgccaacagcaatttccacagcactaggagcgtctgctggtttggtgctggcatatggggttatcgtagcgattccgactgtttacattgctggtccattattttcaaaacttgcgcatcggtttgttcctgatgcgtttgagcggcgcggtaatttaaaagcactaggcccgcaaaagacctttaaactggaagaaaccccaggctttgggatctcagttttgacctcgttgtttccagtcattttaatggcaattgcaacgatttatgaattggtgatttacggtggcaaaatgccaaagaccccgtcaggcatggataatgtaattgcttttattgggtcaccaagcattgccatgttgatttcgcttctgtttgcgatgtgggcaatgggttatgcacgtcagttaccggctaaggacatcatgaccacacttgaagaggcagtgaagtcgattgcgatgttgctactggtcattggtggtggcggtgccttcaaacaggttctgatagatggtggcgttggtgattccgtgaaaaatcttttcgtcgggtcatcaatttcaccattaatactcggatggctaattgcggttgtacttcggattgcccttggctcggcaaccgtagctgcaatgaccgcttccggactagtgctgccgctgatgcaaagcgcaggcattcaaccggcattaatggtgttagcaatcggtgccggttcgttagctgccagtcacgtgaatgatgccggattctggatgttccgtgaatattttgatctgactatcaagcaaacattgttgacatggacattgctggaaacgattatctccgtagtcggtctcggcggggtgttgttgttaagcttggttgtctaagcaactggtggaaaacgccaatatttaacactgacagagtcgctctaacgcctaaagttggagcggctttttggatcaccgcaccagttgttgctgttgacaatgctaaaaaatctgtgaataaaaattaacttaatttggtttacatcagtcaacaatactttagttctcatttacgtcattcaatcgaaataatgaaaattcataaaaaggttttaaaattcaaatgattcgtctagtacgtgcgggctcgaccaacaaaaatgttaaatttacgtgtaaatcgtgataacataaatgcgcgtgtgctagtttatcgaggataagagtcatggtagtgatgcggtcaaattaggggacgcaaaggcaaaggttgaaacggagggttgtgattgctaaacttggtgaagctagtttagctgtcataatatagaagcgatcggagttaaaatgaaaaccaaagaaattagcaaatttgagcgttattttctgtacatattgttttttgaactgtttgctggcggtggtggccgacttattgcaatcgggccgttgtcgattcggcagattttgtttgttggcgtgatggcagtattccttgtgcgctttattttgaacgctgatactagaaacgagatctggggatattttaggcatccgaatacagcggttttctggttatcacttatcatgttgttttgggtcggtatttcaagtgctattggagtcatgcacgggcatggtgtgggattggttgcgactgacttcttccggacgatctacgttattatgatcctgccgtttatttactacattggtaaggatcggttttcacttaaagatctcatgcgttgtttgtttgcagccgctgcgttagtttctattgttacggttcttatcagccttatcggtaagtttgcaagtgacatgagctttcatcacttttatgattggattaatggtgtgatgccaggagatttattcttccgaccttcaaggggcgtgttttataagtcagactttttagtcatgtttgttgtgattatttcgctaattaaactcgcggaaaagaaaatctcctggattgagggaggcgttctggttgttggatcgctttccattatattgtcagaaagtcgaggcctttatttaggcatcttaaccggcattggtacttatgttgccgttaaggtagttgtttatttctggggtgatcgtcattctttaaatttgaacaaaaaaatgaatttccggcgagttgcggtgatactgcttacggttgttttgtgcggctttttttacagtaatgccaccattgctcgttttagcaagccaactaatgcagatttgcgcgaggagcgtaaatttaagtggcgtgatgccaatgggggagggaacgacacgagtttgcgctcgcggtttgttcttcttactgatgccacgaagattattgaaaaaggttcgattgtcaacaaggtggctggaaatggttatggaacagtcattggcgatcgtaaggatggcatcgaaatgagctttgttgatatcttggtggaacaaggcgttattgggcttgccatctggttggcgttctcattacttccgctatattatttcttcaggagtttcttgctaagtcggcaattagcggatatttatattggccttttgggaagttcactctcaatgattgttgtgacaaacattaacccatttttgaatagtccaattggattagggttcttgttacctgttattgtgattgcgtataaatcgttcatcgctaccaaagatagtcaattgacaattaggcaggcttaagaagataagaactgcaattttagactgaaaagttggaggcaaacgatgaatcgagacggccacagtttcttaatcgtattgtatcgccagaagctaagcaaaagtaagacctttcaaacactgaattcgcaattaatggagaatgatcacttaattatttatgataattctccggagtcgatgttagatgtgaagccggccaatttaacctatttccatgatgaaggcaataccgggcttgcagctgcgtataattttgcggtgcaacaagcacgaaaacgtggcgatcagtggctaacgattttcgatcaagatacaacacttcctgccgatttcaaccaaatagtcaaaacgtctatgcgccaaaccgcaagcgctgttgtcttggctcccgaagtcgtgctggctgatggaaaacagatttcgccattttggatcgaagacgcattgttttttcatttccccgctgcggtttccaaaacgcgtgctgcaattaattcgggcatgtcgcttaacttggcggcgttcgaagggacagcaccaatttttgatcgccgatatcctctggactttctagattacgttttctttaaacagttacaaaaggccgggaaagagcttaaagaaattccggttcgattgactcaagaactttcgctaaacgattttcgcacgatgagccaagttcgatttgaaaattttcagcgaacggaagcaaggtttgtggctgaattttatccgcgctttatcccacaatatcgcaggcgcctatgctttaggctgattaagcagttattgaagcgcgcccagtggtcgaaactgaaggtgattatccaggtgataggaggaggaatagctccatcatgatttctgtttgtatggcaacttataatggtgctgccttcattgatgcgcagctcgaatcaatcttgatgcagctcgatgcggaagatgaggtcattgttgttgatgatgggtcgacggatgaaacaatcgcgcgaattaaccaacacaatgattcccgaatctccttgattgaaaatgcgactaatcggggtccagtgggtagtttcatggttgcgatgacccatgctaaaggtgattatttatttttagctgatcaagatgatgtctggcatttggataaggttaaaaaggtgcgcgcggcctttgaggatcaagatgcaatggtggttgtccatgatgcgattgtgaccaatcaaaagcttgaaacgattgactcatcgtggaatcactacaatcatagcgaacccaatcagtcgctgctgagaaccttgcttaaaaatggttatacaggagcaatgatggcatttcggcgcgaattgttagcactaattttaccttttccggcaaagttgccgatgcatgattggtggattgcgttgattgccttaaaacatcgggaaaaaattgttattttgcctgaccgacttatggattatcggcgacataccggtagcgtcacgggtaaacggcgaaatctgggtgctgttattaccgatcgcgtgcgcatgctgcaaatgttgcatggacgttaatgaagagttaacgcgactatcgaagtgaggaaggcaaatggacactaaaacaagaattgcggttttgatctcaacttataacggacaagcatttgtcgaagaacaggtacaaagcattttgtctcaggcgattgatccgttgaaaattgagcttcatgtctatatacgagatgacggttcatctgatcgtacccgggacatactcgctaaacttgcagacgcacatccagacatcatcagaattcagaccaaagcaccaggcaacattggcgtcaaaagatcctttttcgttttagttcaagacccggaaattgatgctgattatttttttctagctgatcaagatgacatttgggaaccggataaaataaccaagaccctggcggcgtttcaaccggaaaaatcttcgctaccactgggtgtttattcagatctttggcttgctgacgcgaatgggcattcaaccggtaaaagtatgagtgagcaggcacggtggcccaagaatctggcagtagattatcagtatctatcatttgattatcgggtcactggggcggcttttgcgtttaaccgaactgcaaaaaaactttttacacaaattcccaacgcttttattccgctggtaaatatgcatgactcgtttatggctctgatcctttctgtctgtggtaaacttatccaaattgacgaaccgcttgtcttatatcggcagcatggcgacaatctaatcggtgggttaaaaaagaagcggagccttattgagacacttaacaacaagaagcgcgaagaaggtcagcttattgttgacaacctattacttgatgcgtttcttaaaaagcaacatcttactattcgacaagatcagcgggctataatagatttgtatgttgattattttaataacgtacaccatgcatttaaacgggttgcaacgagtgttaagatttaccacatcatgcatcatccaagaaaaagagtttcatttatattgatcgctttttttgatgttattgacatgattgcaccatatgatgaaataaaagctgctttggcatgagttatcagaaacctttaattgtgtgcggttttagaaaattcttaagatgctctttaactggagcatctttttagcatgttgctagccattcaggcaacgggttattagcgtgtcagcagtttggatgacgcgaacttgctaagtttgctgtcggggttggttgaaatctggtagaatcacatggtattggtaaaattgcggtgattggctctgaagtagtttctaagctgtctatcgctgttatgagtggagatttttatgaaggtcattaagaattttttttggaacgctggctatcaagtattcgcacttttggttccattggtgacggtgccatacattaaccgcgtgttaggccctactggtgtcggcatcaatgcttttacaaactcagtcgtccaatattttgtcctcctgggcagtttggggattaatctttatggtaatcgcggtactgcataccggcgcgatgacaaacaggcgatgacgacttatttttgggaagtcaccattttgcgcttcctagcgattggcctatcagtgggcgcataccttgtttttattatgatggttgataaataccgcgttttttacttggcacaaggtttgctgttgatcggagcggcgtttgatatttcttggtttttccaagggctggagaattttcgagtcacggttgtgcggaatgttctggtcaaaattggctcagttattttgatttttttattaatccacaaacctgaagatacgatgctttatattttaattctatctggctcgcagttgatcgggaacttaacattttggccgtacttgcgcaacagcttagcacactttccaaaactccggaccttgcatatttggcagcatgttcaaccggcatttttgttactagtgccccagttagcaattcaaatttatgtgcagctgaataaaacgatgctcggtattttgcaaggagttgcagcatcgggattttacgaaaactcagataaaattatcaaaatgctactggcgcttgtgactgctactggaacggttttactaccacacgttgcccattattttgcaaaaggcgatcatgatgcggtaaagcgttctttggaaagttcgatgcatgtgattctggtcatggcatttccgcttgcatttgggattgcagccgtttctaaatcatttaccttttatttctttagtgctaaatttatgccagttgcgccgttaatggcagtggaggcaatagttgtcattccgatagccattgccagtgccattgggatgcaatacttactgccgaccaatcagataaagtcatacacaacgtcggtcatcctgggatcaattgtgaacatcatcgttaatgtgccgctcattctttggttaggaacaatgggggcggttgttggcactattctttcagaaacggttgtaaccgggtatcagatttattccgtgcgtcatcagttatcactcggggggctgtttagtgagtcatggaaatatttacttagctctgtagttatgtttggtgtggtgtgggctcttgagcagctgtggtcgcgtagtttaataaacttagcgctcgaagtggttatcggaatagttgcctattttgtcactttattagtattacgaccacacattgtttttagctatgtcaagccataccttgatcaagttcgacatcgcttaggacattagcttgattcacgaaaagttgtgtcgtgcattggtcaacagaaaggaataaaatgtcgattcaaaaacaactcaatgcttttaaaggcaaacgcgtgcttctcctagcaccaaaattttttcactacattggtgagattcttgatgctatgaaagatgctggtattgattgcgattttcttgatgagcgcccgttacctggcttcacaggcaaagcgattgcgcgttatgtaccggtggttaatgaacgcaaggtacgagaaaacattagacagcggcttagcgagaatcattatgactacttattagtcataaaaggggaatcgctgagcaccaagcttttgtctgacttcaagcaagctaatccgggtgcaaaaacggtgcttttcctatgggattcggtggctaattccaagcatgccaaggcgtttttcccggacttcgacagtgtgtataccttcgatgccaatgatgcggcaaaatataaaatcgagttcttacctctgtttgtcggatcccagtttgatccgcgtctcacggcaactgatcagcagccgaatattgaccttgcttttattgggaccgtacattcgaatcgcagtgaattgttgaatgtgatcgaagagctggctcatgaagaggcgctttctttttatgactttcgctatgtccagagtaaattgatttatgcggtccgttatatgcaagattcggcgtttagaaagtccccagaaggcacgatacactttgacaagattgccgccagtgagatgcttaaagtattgcgacaaacgcggatcattgtggacgtgacgcatcccaagcagactggcttgactgggcgtgtaattgaaggcttgtcaatggggcggaaggtgctgacgaccaacagcaaggttttggactatagcttcattaaccaagaaaatgttcaaatctttgatgagcatttggcacaccttgataaagatttcattacatcgccgtatgttggcaatccgctgacggtttatcataacttttcggtgtataactggcttggaacggttttgtccggttcaccatacgcgccagttagcgattagtagatttatcaatcgcgagactttttatctaggagtaaactgcgagaaaagaatgatgaaccgataacgttcatagatacagaaacggagattataaaattatgtacgaaccaaccaaaaaacggcgcgttgccgaagatgttgccaagatttttcctgaagaagtgacaaatcagatttttgatgtgattgcggtgatgcgtaaggccaaacagattgtgacggcgccggttgcgattgctttttccgatgattataccgatgacgaaatgtatgcgatgattattcaaggcaatttggcaccggcgcaggagtttccgctcacttacaaaggcgacaagccattcttaggtcatggctatatcttagtggtcaaggacaagcctaaaacgatccgaattgacttcagtgcggccaatccattcaaaactgcggaaaaggactgatctgcgggtggccacagaggcgtgatttcacactcatggctgctcgtataccgatcatccacggataccggcttttgtgtgatctaaatagcactggtcttttcatgaaaacttcggtacaatagtaaatcgtaatcgttaccgtttgctattgggaggcagctatgagtgaaccaattttgaccgtggaccatcttcgtttcgggttccgggatcagcagctttatcaggatttgagttttcatttggatgttggctccatgacgagcttggtcgggccgaacggggtgggtaaaacgactttgattcgcctgttgatgggccagttgaagccgcaagccgggaccatccgttttcgtaagcaaccttcagttcgattgggatatgtgccgcagtttcgaaatgtggatgccgagtatccgctgtcgatccgtagttttattcagttgcgccagttggatcacctttttttctggcatactgccaaggaaaaggcggctttagctcgggtgattgaggcgacacatttaactcaaatcgcgaatacacggctgggcatggcgagtggtggcgaaaagcaaaaggcgtacttagctcaggcgctgttagatgagcctaattttctgattcttgatgaatcgactgctagcttagatgttaatacgaagcacgagttaatggacttggtacaagagcttaaccaaacccaaaaattaacggtcctgtttgtcacccatgatctcagtttagccaagcaatataccaaccagtatttattgctgacgggggacagttacgaaatgaagccgactgcggaaatgaatttggcttcaatgccggaagagttacgcaacgatgccgagaatcgcggggtgatcgcatgaatctatttgcctatgcttttatgcaaaatgcttttatggccagcacctttattgcgattacaacggggattgtcggggtctttgtggtggcgcgtaacatgtcctttttggcgcataccttgtctgaggttggttttgccggggcggcgtttgcggtgtttgccggcattaggccattggacgggatgctgctctttaccgcgattagcagtatcagcgttgggcgcatgtcggttcaagcctcacgtcgggaagcatcgatcagtgcggtttctagcttgtttatcggtttagggattctgtttttatcactttcgagtgcgaatgccagttatgccacaacgattttgttcggcagtattattggtatttcccagggtgacgtgtggcagctggttgcattagccgcgggggtgttgttcaccttgtattttggttatcggcggttggcgtttgattcgttcgattcggtcggttctgccgcacaggggttgaagagtaagtatatctcgatttatttcctacttattctggcagtttcggtatcaattggagcgcagattgtcgggagtttgctcgtgtttattcttttgacgctgccgccaaatgttgccaagtatctgggtaaaacgttgccgcagatgattgtcatctcggttgtgaccgcattgatcggtgtctggagcggcctttaccttggctttttgacaaactggccggttacgttcttcattgctgcgattgagtttggtttttactttttggcattgtggtatcaccaaaagacaaactaaaagctgcttgtttgttttcaaataaaaatggccctagagcgacgagaatctcgttgctctagggctattttgatatctgaggctgtaaagaaccattgttggcgccagtgggttatcgatgcggtttaagttgacgcaaaaaagtcgttacttctgcgcgataatcgtgcttttgctcgaattgtgccagataaggagcattatgggtgctagtggctccggtatgccgcagcttcgtatatacctctaagtaaggcaaggcagcttgtttggcttgggctaattcggccgctgcgtcatatggaacctgacgtaaatccagatccgtcattgccccatgatgaaggctcagcaaagcatagtctgcataagtcgtggtttgtaaatgtggccgcggtgaatacgcttgaccaattgagccgggattcagtatcacctgaccactgctggtgtagcgcagtaattgctgatgggtatgcccgtaaagggcaatgtcgattttggggtcaggcgcgatctggtcgaaattgctttgtggttgatccggataaagtcgatggccgtggttgctagtcggcaagttgtgggcgagactgatcgtcagaccgtcttgttcaaagatttcgtgtaatggccagtggcgaatggcggtcagtatatcggcatttagctgcggccataaataagcaacgagccgactaaagtagacatcggtgggctggtttaagtctaccgggccgtccaatacccagaataggtcatcatcccagttgcccttaaccagatgtgtcaacggcagtgcatgcagtcggtcccaaagcttagctgcccccggtcccggtaggaataagtcgccaaggaaccagtattcgtcagcgtgatgtgcctgtgcgtctttaagcactgctgaaaaggcggtcatattgccgtgaatatctgataaaatggcgatttttgtcatgcgttcctccagtgatcgttcattgtgactaagccttgcgttcccagatcgcctttaccggttgccaccatgttagcgtatagctgttcagccagttgggttgccggtaactgcagatgcatttttttggcttcgtctagggcaattcggagatccttgagaaaatgtttcgcaaaaaagccaggggtataatcgccctgcaacatgcgaggaccgtaattgcttaagctccagttggcgccggccccactgccgaccaccgtgagcatttcatttaaatcaagtccggccgctttgccataaaccagcatttcagtaagcccggtcatggttccggcaatcataatctgattggccatcttagcatgttggccagatccagctgggccaaaatagttaaccgacgttgcgatcggtgcaaataaatccttcaatcggggcaacagagatttttcgccgcctaccatgatcgtcaacgtgccgttcttagcgccaatgtcgcctcccgaaaccggcgcatcaatggcatgaacccctttgtctgcagctttggaagcaatgcttttggctagtgttggcgtactcgtggtcatgtcgatgattaaatcaccggcgtgggtgccagcaagaaccccgtcacagccataataaacggtttcaacgtcctgaggaaaaccgaccatggacatgacaacatgacactgtgccgccaccgcatgcggagattccgcccaagtggccccggcatctagcactgtttgcgcgtgggcttttgtgcggttgtaaacgatgacctcgtgaccggcattaagaaagtttttaacgatcccggtacccataacaccggtaccaataaatccgagtttcaaacgactcatcctttctgcaagattttttccaattccgtcaagcgctgttcaaatactgaaaaggcggcttcaagataatcgggtttggtcatatcaacgccagctgttttcatggtgtcaatggcatacttagaactccctgacttcaaatagtctaagtaatgggcagccgcgtcaggttcaccgctactgatgcccgctgctaaggttgaggcagcagcaaagccggttgcatactggtaaacatagtaattgtaatagaagtgcggaatgcgggcccattcaaaggcaatttccggatcgcgtgcaacttccggtccataataccgggcgttgagatcggcgtaatattgtgacatgctggtggccgtcaacggttcgccttgctgatcctgttggtgaatccagtgctcgaactcggcaaattgtgtctgacggaaaacagttcctttaaaaccatcgagatagtaattcaaaatgtaggctcgtactttgggatcatccgaatgtgtcaggaaataatcagttaacaggttttcgttggttgttgaagcaatttcggcaacaaagatcggataatcaccatagacatacggctgattgtgacgcgtgtaccaactgtggacgctgtggccggtttcgtgaaccaacgtatagagttcatcaacggcatcgtgccagttcaataagatgaacggattggtatcataagcaccaccggaataggcacctgaacgtttgcctttattttcgacaacatcaatatagcgattgtcaaaaatttcgcgaacatgctcaagataatcatcgcctagtggggctaaagcttttaaggcctctgctttggcttgttcaagcgtataagtcaacggcggctggccagtcagtggtgtgtaaatgtcatacatgtgtaactgatcgactgccaacacctttttacgcaaggcgacataacgatgtaaaagcggcaggtgggtgttaacctggtcgataagcgtcgtgtacacactttccggaatgtgattacttgccatagcggcagcacgcgcatttttgtaatgatgcgctgtcgcgttgaaattatgggctttcacttgaccacttaacgtttgcgcaaacgtattttttaaactttcgtaagcacgcagaagggcctcgaaagcctccttgcgtaatttacggttagtcgagcgaatcaactgaccgtacaaaccgttactaagctggacggtttcgccatcttcattttcaacaaacccgaattgcagatcagagttgtttaatacattgaaggtcgcgtgactggcatttaaggcatcgcccgcacttgcaatcaaggcctcggcagcggttgtcaagacgtgttctcgatttaccgtgatggcatcaataaaatgtccgaatggcttcaagctttcagtgtcacgccaggccgttaatttgtcgcttgggatcgccagaatttccggatccaaaaacgctaactgactggctaattcagcacccaggctttcagctttggcattcatcgcctgataagtggcgttaccggtatcttgatcgctttttaaacttgaatagacgtaaaccttctcgaagcgtcgaaaaactgcaagtacggctttaatgccggtaacaagggcgtctgccgagttgcctaacgttcctttcaatgcgacggccgctttggcttgggcacggacagctttaaagtcggtttcccaagctgaatcatctggataaatcgttgtcaggtcccaggtcaattgcgttgggacatcctctcgtgctggtaaatgttgcatctaatcagctccaatttctaatatttctttaatgttaccatatcaagccgatttttgagctaattcccttttttcttcataattatctgatacactaccgtggaaactaaaactggagtgaagcacatatgtccaagcaacaaaaatctgatctacgaatcaaaaatcgcaaacccaaacggcgccatccgattttacgtgcggtggttctcattgtgctcgtggccctttttctggcgggtggctatgcagccaggttctactcacaagcaaaaaaagcagttgcgaagacttatgacccggttagcacgaaaacagtcaattccgacctcaatggcaaaaagccaatcagtattcttttgatgggtaccgataccggtgcttttggccgcacggatacaggtcgttccgacacgttgatgcttgtgaccatcaaccctaaagaaaagaaaacaacgatgctcagtattccccgcgatacgttagcagaaatggtggggacaggcgatcaatcacctacctatgagaaaatcaatgcggcatactcatatggcaagtcagacgcggcgatcaaaaccgttgaaaaattattgaatgttccgatcaactattatgtgaccgtcaacatggaaggactacaaaagattgtcgatgctgtcggtggagtggacgttaatgtgccgtttacctggacggatgcaaatacaggcgggcaaacctttaaaaaaggtaaggcgcatcttaacggtgaactcgctcttgcctatgcccggatgcgtgatgaagatccagaaggcgattatggccggcaaaaacgtcagcaggaagtcatcaatcagattgttaaacacctgatgtcagttaaatcactgacgaactatcagaaggttatggactcgctgtcatctagcatgcgaaccaatcttacttttgatgacatgatggcaatcgcccaaaattatcgcagttcggcttcaacgattgagcgcaaacagctgcaaggcattggtgtttatattgataacgcggcttatcaggttatgaagactgatacgcttcaaaaagcatctgatgaaatgcgtgctcagctaggcttgtcaaagaagacattgaataatttcaatacccaccaaaacgaaattaacaattcgcttgggttcgattggactggcaataatccggtttatacggtttcacttgatggtgtgaccacaggaccttgaagcgtttgataaagttagtgtcaaaaagcatggccacttcggtatttgaaggcgaccatgcttttttgtgtcttatggaaatgatgatgaaggtggcatttaaaatggttactctggatcaggtaaatcaggtgccaattttgcgccgcttaatttagcagcagcaagaccacttaagaagccaatgataaggaacggtacaaagtccatgccaactgagaaccaaggaataaaggtggtagcaaagtgctgaatggctgcgaagaatggcagttgcgctaagctcgtcggcagggcatgaatcgcatcaagcaatgcgggaaccagcgtgaaaccgatcgtcgttttgtaaatccgggtatttttgccaatccaaggatgaagcaagcctaacataatcagcgcaatggctaatggataaagcagcatcaagatcggcgtggaataggcgataatttgatcgagcccaaaattggcaatcagaaaagcaccaatagttgtgatcggaagaaagaaatgatagcccagtttcggaaagcgatgtcccaaatcctgtgaaaaagaggtgaccagaccaatggcggtggttaagcaagccagcagcgtcatcgctccgagcaaggcagtacctataaggccggtgtaatgcgtcataatttgattaaacgcggtgccgccatttgcggtgatcttagaaaagccgagactaatggcccctaacataatcagcaggatatagatgagtgcttcaagtcccattgccaatgagccaaccttggcaacggctttagcccgactggaagcatgatgtaatcccatcaatttcagcgcggtaatgatggtaacgccaaagcccaacccggcaagtgcgtccatcgtgttgtagccttgtaagaaaccattggtgagattgccggtgataagttttgcattggcagtgaagctaatagctcgaatgtcgcctttaattaacaaggcccagaagaaaataatggccagtaaaagcaacaatagcggattcagcagcttaccgatgtaggtcgtgattttactttcattgcgggcaagcagaaatgttatcaaaaagaaaataaacgaaaaaatcaacaaaccgatttgctgctgccccttgtttagaaagggtgcgataccaatagcgtaagtaacagtggcggttcttggcgaagcaattagcaatccgagactggcatgggtggcaagcaggaagaataaggcgaatccatggcctgctggacgagcgagatcgtacatactactcgcacgggtaagactaatggccatgatggatagcagcggcagtaaaacggccgatagtaagaacccgatggcagccggtagccaagccgctccggctagctgccccatatgaatcgggaagattaaatttccggctccaaagaacatgccgaataacaaagaaccgagtgtgaggtattgacgtttggtgagcttagcttgagttgacattgtagatccctccatgtttataaaatcactgcgacactgaatgctgactgtcgggtattttttccataagaaaagcccttaacagtcagaactgttaagggcgcggatcacgctgtaccaccttactttaccgccaacgtcaccgaaagcggtctcgccgcgtacggcctgattcggcgatacgcgattgctgtaatgggcgcaatcccagccattacttccgaagtcgcaatggcaactcgtagactactttccactagataatcagaggtctcttcccaccaaccgagactcgctgacactgacaatctaggtactcttctactcatcgtttttgaaaatctgttgaattgatctttattttacgaagaagtgggaaaaagtcaaatacttttttaaaaatatgagttagtttgatgagaaatatgagggctaatggggaagcagtacccgttaaaatgcccatataaaggcaatggtgctgctgacatccaaacagttggctagtcatttttcctcatatcaatcatgacatggcctgaagttcacgatagtcacgactggctgaaaaaatcccgcatttaaccaatgaacagaaaaaagccctctcgctcacacatagcgaaaggactttctgattttagctaataaattagccaacaacttcaactgtggctgtcatgacgccagctgaaggaatctgtgagttaggcatcgcgacatccagctgattaggattgccgttagcaaaactaccggtgtcattaacggttcgataccaaaccgtgccatcggataatgtaatcttcaggcgagtcccctttggaaagacggagagattagctgcgacaccatcgtaacccatgcttgaacccaagacggccggatcatagaagcttaacttaaaggtccctttgttagtcgtggtttgggttgtggttgcactagccgcagctgcacttgcgctagccgcctgctgggctgcttgtgcctgagcctgttcctgggcagcctgttgagcagctgcctgttctgctgcagctttttcggctgcggctttttcagctgcagcctgttcctcggcagccttagcagcggccgctttttgctcagcaatttgatgcgctgcttcggcgatatcgtttgtgccgactgtgatggtattttctttcttcgggttgatcagtgaataagtatccgcttggtcagcctttacttcattctttgcctcgttgcttaacacaattgacttagctctaacttgactattgtcactatcattattggcgtgatcagcgatggcttctactttttgtgaatgattacttgtcattcctaatagaggcgccacactgagtaacgcgatgatggataatttgatttgcttagtaaagataaaaattcactcctatattttgaatagtcgtcattttgttcccccgagaacacaaacgaagtatatagggatggtgtgtcaataaaataccagcatcattacaaaaacatctaaattggtaatattgttacgtggatgtaacaaacggaatgttaaaaattttcgtaacaatcactgaacttttccggaaaaagtgggctcaacccttgaagtttctgtgatttgcggcacttttctaccataatttgtgaatttttggaaaatttttgggtgcctaaactttcgtaagtgggaaaatgttatgctaactttatgtcttcaagtcagcatttgcggacatgaagaatgggtggtcaagaccaaagcttggtatttggtggcttgagatggatggattattattgatattttttattcattataatgtgctcccaggtgcagaggacgcttacactccggtttctaaccgcgccggctcgcgctcaccataacgcgctccccggcgcagaagtctgcgtgtaaggacctaaaatgcaatggccaaagcccagccatcacgttttaggccgcttacactccgacttctaaccgcgccggctcgcgctcagctttagttaacgagtttttccataatcaggtataataagacaagacagacgtaacctattatttacaggaacttacaggagcttaaatgggggaagcgtctatttaagggaggacttgaatcggtggcaatgtatcgggagaagcggtttgaagaaatcaagaagctgttggcagcgcgtaatgagctcagcatcgaagatattatgaaggctgttggcgtttctcgtgacactgctcggcgcgatatcgttgccttagatgctcaaggtgttgccagacgtacccgtggcggtttggtgtcgttgaatttcggccacacgattcccagttattcgacccgcttgaaacgtttttctacccagaaaaccaaaatggccaaagcagcgttatcgctgattaaggcgggcggcgtttactttattgatgactcaaccacgcttttgaaattgtcacaatcgattcatcatccagtcacggtatatacgcatagcttggacaacgccattgccctttcagtcgaagaacgggttaatttgcatttgtttggcggtaagctcgatcaccacgcacggtttttctttgagcccacgatgctggagactttgcggcgaattgcttttgatgctgcgtttattggcgccacagcgattgccgaagatggcgtgtatttttcttatatggaagatgctcaggtcaaacaagcggcggcgttatcggcacggcaggtggttgtagtttccgaaaccgaaaaattccagatacaggcaccgtatcgcgggttggaacttggacagattgatacactgattactgataagaaattagcgcaaacgcaaaagcagtggttcccgactaagacggacttcttaatcggtgattaataccaacttaagtaaaaaggattgatatgtattcaatttcagcaaataggctatcaacagcggacacgtcaggaggtgtcgccatggtaacgccacttgtgacgatcattgtgccggtttataaccttgaaagctatgtggcgcatggtttaaaaagccttttagcacaaacttactcccacttacagattattgtgatcgatgatgcgtcaagtgatcgctcgccgcagattgtgacccggtttgcgcaacgggatcggcgcattcaggccatcttaaagccggtgaaccaaggtgtttcggcggcacgtaatagcggactggaacaagctcggggtgagttggttgcgtttatggacggagatgactggtatgaaccggacttcattgcccatgccgttgatgtgatgactcagggatgggatctcattgccatgccgtttttccgtgacgatcccaatccacgtccggttcaagaacatctgcgtaaggcgaagcaattgacaagaaaagggctcatccggcagatgctgcaccccattggttatattcgcggctatttatggaacaaagtgtttcggcgggatgtgattgaacgcctgcaattacgctttgatgaacagatgtccattatggaagacgagctttttaccgccacatatgtgatggcaacgcggcattttttgtataccggacatccggcgtatcatcatgtcgtgcgacgggattcggccactcaatcgttaggtgttctgggggcaatcccgcagcagctctatgcgttgtggcgcattcatcatgtgttgcgccatgcccaccgctacgaaaagggtactaaaaaagaagcaattaaaattgaccattaaaacaaaggagtatggatgttgaccgagaatttaatgacttaccgagagctcaagcataaggccaaagaacaactaaagaccgggacgaatcgccgcgatttgatgctggcttatctactgccgagtttgttgcaggcggcagcctcgattgttgcttatttggcgattttggcggtgattcagagcttcggggtagaaaaaacactgacagatccaaatggctttcaagcgtattatatgcaaagtggcaacaacaccgggacactcaataccattcaaagtctggtgaataccatgctggtgcaaggggttaactttgcggtgctggatcttgtccggcatcagacgcgcgttcatccatttcgtgcggtattgggtctttttaacggcaagtggttctggggttcgatttcgctatggatctttacctatttcctgacgcttatcggcttttccttcctcgttattccaggtgttttgctgatactgggatggcggcaggctttttgggttttcaaagacggacatgaagcagatcaacgtttctcatcgatttcggcattgatcggctcatggcggctcatgcgcggttttaaagctaatttgctcgggttgtacgtctcgttaattggctggtacttgctggaaaatctgacgttccacctttttgactgggcgattaatccctatcttcaactcgtgcacgctaattactatgagaatcggcgtgcttataaaatggcggcgcaagcgtagtccttttggcgtgtctttttaaccgcagcggcgtatactggcggcgtctaagtttatgaaggaatcagacaagtgagaaggatgggtgcttttaccatggaaacagaagcatacatgaccttggctgaagtcaaaagccggcagttggcattaaaacggcaggtaccacttgatcaagcgattgcagagaatattcagaactgggcacagtggttgttggacgaagggtttgaaggcagttattttactgccaagctagagggggcagctattttgattcgtgatcttaatggacagctagttgcaaccataacgactgatgcgcctagttatgtgacggcgttcaagcaggctgatcggatgacgatgctcgccattcaaacgaagcttcggcgtttaattgatcagcacgggctaaccctgtcgtgattgagcgcaggttggctgacgactaaggctgagaaaatttcatgacagaaaagcagcgatcaaaaaaataccatccgccgttactgaagtgagtaacgacgggtggtacttttcgtgtatcttataaatcaaaaaatcttcaagcgatttagcggccaatagcgccaaacgacgactgactgaattttggatttatcaacgaatccaaagtcacgactgtcatgcgaaaccaaccgattatcccccatgacgaaatacttgccagcaggtacttttgctgacttagttgaagatagggttttgatgttgaaatcgttggtgaatttaatcgtggaggaatccagcccttgttgactggcccattgattaatttccgttcgtgcaaatttgtgattcaagtaaggctcggcaatggcctttccgttgacgtaaagcttatcgtttttagcgctcaccgtgtcacctggcatgccaatcacacgtttaatatagagggattttggtcgatcaggtgcatttattacgacaatatcgttgcgtttgggctgcatgacgcgaacggaataaagccgttcgccgttttccaatgtcggctgcattgacgtgccttggacaacatctttgctgacgacatatttcatgagcagctgggtcgcaaaaaagatgacgatgaagagcacaagaaattcgagaatcgttcttaagacggaatgactgttatttttcacgatggcaccttccggtagagatttacttaagtctaccacaagccttgtcgccacgactaaaaagttcgcttgtcaattaatcatatttcgggaaaaaaacgcttttttcagcttgccggcagagatcgacaatctgggcatattccgccagtgtcaaacaccaacgatgcggtaagcttgtgtacccataagctaacccagccaagccgccggttaatgccgcagcggtgtcggttgccccaccaagtgcaagtgcgtgtaagacggcatcgtgataatccggccaagtcgaaagcgcatgcaacacccgaacgagcagacttaaaggatcggttgccgtagcatcaagtgaggtgggtgccgcgagcagagattgaaatgagtcaaaaaccggttgttccgcctgcttattggcaaaatagtcgccagccttggtgataccggtagcgatggcagttggcaggtccggggcatccgcgagtaattcgatggcgatttgggtgtaaatagccgttgctaccatattctccggatcggtgttggtgagggtgacaaagttttgaaagagacgactaccctctgcttttttgaatagatctgtgtcaaatgtttgataagcaaaaaaagcaaatggtaaagcgcggatcaatgctcctggttcgttaggcgccgccgcagcttttccagtggtcaaagcagttgccacactaggccaaatatcgggattgcgttttccataaggtgcgtgttttccatttttaaaccacgcttggtaagcagcgattagctttgcctgatcaaagccggattgtaaggcgtctaggccggcaagtgtgaggccggtttcatcggaatacgtgccggctggttggttgaaggtgccataacccttcatggtcgtgactggcgcagcagccagatcggcctgcgactgccccttaaccggtaatcccaaagcgtcaccgattgcaaacccaaccgttccgtgaatcaaacgagattccatgatccccatttttgccatctccttatcaaaatactggttcatgcatgtcgcatttcaagcagttgtcaccacaaaaaccgcgatgaggtagtaaataccaccgtctatttaatcggctgatgcagtcattatttctccggagaagcagaaaatgcaaaaaatttgcctcgttgtcaaacatcaaccgctgtgatagcctagctagcagtagctattttcagaaagctgccgtgttgagtgcgttgacggccggtttgaattcggcctgaaaagcatactggcagcgagataatgggcatgatggggcatcataacagtgtgcggatggtttgaaaagccaaaaccgcggcgaatgagagtacaagcttttttaagataggcttcaaatgatggcgtcagtaatgcttggcggtttttatagaaggagaatgaaatgagtgttttaaccgtaaccgggttatcgcagcggtttttagacaaggtgttgtatcaagatgccagttttcaggtgaatattgaagatcatctcggtgtgattggccaaaatggcgtcgggaaaagtaccttaatcaagattttgactggggccttaacaccggatgcggggaagattatctggcaaaagcatcttcatgtcggctatttggaccagtatgccaatttggtgccgggacaaacagttattgagtttctgcggaccgctttcgatgagctttatcgtaaagagaccaagatgaaccaaatctatgccgattatgcggctcacccggatgatgagcttttagcgaaggctggtgaattacagcaagagcttgaagccggtgacttttatgagctcgaaaccacgatccagacagtggcagaaggcttgggcatcacggcgatggggatggatcatccggttgatgctttgtctggcggccaacgctcgaaactaatcttggcgaaactgttattggaaaagccggatatgttattactggatgaaccgacgaattatctggatgtttcgcacatcgcctggttgactgattggctccagaactttgaaggagccttcattgtgatctcccatgattttgactttctcgaaaatgtgaccaatgcggtattggatattgagtttggccaaatcaccaaatatacagggactttaaaacaggctatgcgtcaaaaagaagctgaccacgagacgtatctgaaggcttttgccaaacagcaggagacgatcaagaaaaccgaggcctttatccgcaagttcaaagccggcacccgcgcaaccatggctaaaagtcgggaaaagcaattagcccgtatggataaattgacacccccgggtacgcgagcaaaggcgcatttagcctttccgtatatgccggttaaccgccaaatgctagtggacgttaacgatctagtcgtcggatatgataagcctttgttgcagccgattaatttttcggtggctaaggatcaggtgattgcatttgaaggctttaacggtgttggtaagtcaaccttattgaagacgattctcggtttgttgccagcactgggtggtagtgtcgagattgccgacaatgtcacttttggctattacgaacaagaactgcactgggatcagcccaagcaaagtccggttcagtatttgcaacaacgctttccggccttaacccaaaagacggtacgccaagtgttgtcacgaaccgcgttgacaagtgaggaagccaataatccgctaacgatgctgtcaggtggcgagcaagctaaagtcaaattggctgatctcatgttacagacaaccaatattttggtgatggatgaaccaacgaatcatctagatgacgacaccaaaaatgcgctgcgaaccggactgcaacagtatcccggcgccgttttactcgtatctcatgaagcaggcttctatgatcattcctgggtcgacacagttgtcaatgtcgaacaatttcaagtcaaagaatgatagcggacaaaggctagttacgatgattaatggcggtgcaacaagctaggacaccaaaatcagacgacacctgagcgaatgcgatggtgtctttttatatacgcgcaataaatgaactgatcggcgggggcacgcttaattcttgggatgccacatcaattgtgtatatgcataggtcaggtgatcggttaccggcatgtgcggattttcatgaccggtcaatgctttagccacacgttccgccgccttgacgcccacaggtaaaccaagttcgggcagcatatcactgacagtcgtttgctcctctaggtggtaagtcagcgtgtgcgtttcaaatggaatttgatgtaagcttaaccaattttgatagccggcaacgcgacttggatcggcttgataagcgaccggcatatcgtggcctaaaagagttagagcgtggcgaaccaaagcatcatcttgctgtgtttgaaagttcaggatgactgtttttcgcgccagagcgtttaaaagtgataactcttccggcaatagcgttggcagttgactgacaaagacaagatcagcacttgtcgatgaaacaagttgatgccaatcatcggtgagataagtcatgcttgtttttttgttggctttcaatcgggtttttgcatatgtaagcatcgccgaagaccagtcaattaaggtgaggtgacggacatacggggccaatcggatagcaaaacggccggtaccggcagcaaggtctatcaatgagtcggctgggagcaacccattagcgatcatccaggtagtcacatcatgggcaagcggtagccgggaatcttgttcagcggcagcatagtctgcggcgaagtgattccaaaaatcacgatcttcctgcataagaaaagaggtctccttttttgaaaaactttttttaaaaaagttgttgacttgggatgggaaactgcgtagtatagtacgagttgtcagtcataaaacattttaagccgctcagcgatttaaaaaaagatgttgacaaagagttgccaatttgatactctaattaagttgtcgcttggcaacaaagtagtcctttgaaaactgaacaaagtttcgtttaaatgtgcagggtccttgatacttcggtatcgaggcaaaaagtaacatttgcgaagtcaattcgctagaacaacaaatcgagctattcgaacagctcatatttatatgagagtttgatcctggctcaggatgaacgctggcggcgtgcctaatacatgcaagtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaaaaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggattaccctcaagcaccctagcgggtacgactttgttctttgaaaactggatatcattgttgtaaatgttttaaattgccgagaacacagcgtatttgtatgagtttctaataatagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcctgcaagtgaatacatagcttgttggcggcagacgcggggaactgaaacatctcagtacccgcaggaagagaaagaaaactcgattcccatagtagcggcgagcgaagtgggaagagcccaaaccgagaagcttgcttctcggggttgtaggactggacattggagttaccaaagttcgacgtagtcgaagtcagctggaaagctgcgccatagaaggtgaaagccctgtaaacgaaacggcggactctccgtccaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaacagttcctgaaaccgtgtgcctacaattagtcaaagcccgttaacgggtaatggcgtgccttttgtagaatgaaccggcgagttacgtttgcctgcgaggttaagatgaaaagtcggagccggagcgaaagcgagtctgaacagggcgcttcagtaggtagatgtagacccgaaaccaagtgacctacccatgaccaggttgaaggtgtggtgaaacacactggaggaccgaacccatgtatgttgaaaaatgctgggatgagttgtgggtagcggtgaaattccaaacgaacttggagatagctggttctctccgaaatagctttagggttagcctcggaggatggatcatggaggtagagcactgtttgaactaggggcccgtcaagggttactgaattcagataaactccgaataccattgatcttactccgggagtcagacagtgagcgataaggtccattgtcgaaaggggaacagcccagatcaccagttaaggtccctaaatttatgctaagtggaaaaggatgtggcgttgcacagacaactaggatgttggctcagaagcagccaccatttaaagagtgcgtaatagctcactagtcgagtggcactgcgccgaaaatataccggggctaagcataataccgaaactgtgggtgcacccgtcagggtgcgcggtaggagagcgttctaagggcgttgaaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgcaaggcgtagtcgatgacaagcaggttgagattcctgcactagtttattttgtttaagcgatggagggacgcaggaggctaaggaaagcgcacggctggaaaagtgcgtccaagcagtaagtccggtagcgagtgaaatgcttgccgccttaaggacaagctgtgatggggagcgaaattaaagtagcgaagttcctgatgtcacactgccaagaaaagcttctagtgagaaataaactacccgtaccgcaaaccgacacaggtagtcgaggagagtatcctcaggtgagcgagcgaactctcgttaaggaactcggcaaaatgaccccgtaacttcggaagaaggggtgctgaccgcaaggtcagccgcagtgaataggcccaaacaactgtttatcaaaaacacaggtctctgctaaatcgtaagatgatgtataggggctgacgcctgcccggtgctggaaggttaagaggatgagttagcgcaagcgaagcccagaattgaagccccagtaaacggcggccgtaactataacggtcctaaggtagcgaaattccttgtcgggtaagttccgacccgcacgaaaggcgtaatgatttgggcactgtctcaacgagagactcggtgaaattatagtacccgtgaagatgcgggttacccgcgacaggacggaaagaccccatggagctttactatagcttgatattgagtgttggtaccgcttgtacaggataggtaggagccgtagagatcggaacgctagtttcgatggaggcattggtgggatactaccctagctgtatgaacactctaacccgcgccactaatcgtggcgggagacagtgtcaggtaggcagtttgactggggcggtcgcctcctaaaatgtaacggaggcgcccaaaggttccctcagaatggttggaaatcattcgcagagtgtaaaggtagaagggggcttgactgcgagactgacaagtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgttccgctggtgtaccagttgtgccgccaggcgcatcgctgggtagctatgaacggaagggataaacgctgaaagcatctaagtgtgaagcccccctcgagatgagatttcccattcctatatggaagtaagacccctgaaagatgatcaggtagataggctggaagtggaagtgcagcgatgcatggagcggaccagtactaatcggtcgaggacttaaccaagtaaagcgcaaactggcgctaagccagcgcgcgtttcgatgaaatacgttaagttccggcaaaaacaacaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgcaaagataagatccggtcattgaccggatcttttttcgtaactaataattcaatgcgacgaatttgatgaaagcgttgaagaacgcttgaaaacactcattaatgagtgctaaattgcaagagcaggtatagaaacgaggtctggataatgccaacaaatgcgacaaaggcaacactaaaatctttgacagccagaggcactgttgttgttgatttttgggcgccgtggtgtggcccatgtaaaatacttgagcccatattaacggcattggaggcggagttatcaggcctaaccattgtcagatacaatgttgaaaaagatccttccttaccacagacgatgggtattatgtcggtgccaacgctggtggtttatcaagatggtcatgctaaggaaaaagtgaccggtgtctatgctaaggagaaactcaaacgttactttgaaaagaagctagaggccgggcgatgacaaacgtgatgaagcaaagtaaggtgaatgaccaaaatcaggttctagctacatgcttattagcgggccggattatgattgaaggcggctccgagatgtatcgtgtggaagatacgatgcggcgaattgccgttaatgcgggacagccggataccttggtttttacaacgcttaccggaatcttcgctagtattgaaaaccaaccctatattcaggaacgcccgattaacaagcgatcaattgatatggagaaggtcgcccgcgttaatcaattgtcacgcttgtttgcggcaaaagaaattgatttgggtgacctgcatgcggctttgacgcagttggatcagaataccccgttttttccaatatcatggcagattctgagtgctgccgtggtgagtgtgacgctaatgattctgtttgcgcaaaaatatgattggtttgatatccccttagcagctgttgttggtgcgatcggcttttgggtcgatatcaaggttaatacgatcacgaatatccgttttatcagtgaacttttaggtgccttggctgtcggattaactgcatggattggcatcaggctgggatggggacatagcctcgataacattatcattggtgccattatgccgttggtgcccggcgttgccattacgaattcgattcgtgatatgttggctggacacttgttatccggcatggtaagaggaatggaatcgattctcagtgcttgtgccattggggttggcattgcgattatttttcgattcttttagtaaaggaggcaggcggtttgtcatggatattcgcgttacttattcagctatcttttagttatttggcaacggtggcgtttgcgattatcattaatgtcccgcgaaaggcgcttaatctcgctggttggtcgggaatgatgggttggttggcatactggctgttgatggaagcaggaatcggacggatgatggcgaacctgactggcgcttttgtcattgggctatgcggtattttttttgcccgctataaaaagatgcctgtgattatttttaatatcccgggatttgttccgcttgtgcctggcgcaattgcttatcaggcggtgcgtgcagtcgtgatggggcaattgaatgccgccttgcgttatgtgagccgcgtcatcatgattgccggtgcgattgctgtcggcttcatgttggcgcaactgctgtcggaattattatacagacgcgctgttttgaaacccaaaaagtgatacaatacttatatgcgatgagtcgagtaagcatgtatcaatgctgaaagaagcagctgacaggttaagagccacccgccggatttgtggggtcagcgatctcaaggttgtggagccagcgagatcctatccaagtttttggatactgcaagaggcagtcagataatttatctggctgctttttttaatgctcaacaggacagcttgtttttaatttgttttttaaaaagtttttccacgaaccaacctgttatttattaacaaaattatcagaaatagcgtacagttttctgggctgaaaatcggcgtgaatataaatggattttgcgtcatgatacagacaaagatgtctcaatgtaaatgactatcaaaaagtttaaaaattaagttgactttttaagtgaaccagattaatattctaaccaatcattaatcttacttgaaagaaggcgggtctatgtcagtcatgtgtatgtcagcaggcacgatgtctgttggggttattaatcatttagccttgttgttgatgtcagggacccgaccgtttgatcaatagcgatcagcgtatcgagccccgtcttcgcattggcaatggggcgctgatacaggcacccattcgttggaatgggtgccttttttcttcgagattaatgacaattcgcggatagacgcaaagggggaaccaaaatggcgaaaaagtttctaaagacgattatcagcacagggatgattgcggcatcagtattggccttatcaggatgtgcgaccaaaagtgctgcgaataagggtaacacggcgggcagcaccattaagattggggtcaatatggaattatccggggctgtagctggctatggcgaacaggaaaagcaaggcgttgagttggcggtcaaacagattaatgcagcaggtggcattaaggttggcaacagcaagaagaagatcacggcgatttatcgtgataacaagtcctcaaccagcggagccgcatccgttgctgctcagttggctaatagtgataaggcggtcgcaatcgtagggccggcaaccactaacgacggcacggcatccatcccgaatgtaacaaaggctggggtgccaatggttggaccaagcgcgacggatccaaactttaccttgcaaaaaaatggcagcgttcaaaagtatgttttccgcgcttgtttcaccgatgccttccagggtgaaaaagcagcagtctttgctaacgataccttgaaagctaaaaacattgcaatcatcgctgataactcgactgattacggaaccggtttggcaaaagcattcaaaaagaagttcgccggcaaagtggtcgcgaccgagtattatcaatccggcgataaagactttaacgcgatgctgacgaatatcaaaaataaaaaaattgatgccatttacgcacctggctattattcagagcttggccttgtgatcaaacaagcgcggcaggcaggcattaaagtgccaattattggtgccgatgggatggctgatccaaaacttgccaagattgccggagccgaaaatgcaactgatatttattacaccacgccattttcaacgctgagtgcaaatcgcagcagcttggttaagaacttcctagctaactacaagaagcaatacaacgcaaacgccccgacgttctcggcactggcttatgattcggtttacatgatcaagcaagcgattgaagatcaaaagtctgctgattcggctagcatcgcaaaaggcttagctaagatcaagaatatgcccggcgttaccggtaccacaacgattgatagcaagcataatccggaaaagccgattgcggttgaagaattgacacaaggcaaaatcacaaaggtgtatacggttaaataatgcgcctgttggaattgcaaaagggggttacatcgcttgcagaccatgatgcaacaaattatcaatggactttcactcggcagtatttatgccttgcttgcactgggctacaccatggtctatgggatcatcaagttgatcaacttcgcacatggtgatatctacatgctcggtgctttctggggctattacgcgattaattatctccactttgggtttgtgacggcgctattgtcagccatgttgatggccagtctttcaggggtattaatcgaatatctggcttatcgcccgttacgtaactcaccgagaattgccgcattgattacggccattggggtttcctttttccttgaaaatgggatgtcgtttttgtttggcgcgaatgctcgtaattttccacaagtcattgcgactaaaacgtatcatctcggcggggtggatatttcaaacgttcagttgttgattttattcacttcgctggttttgatgatactgcttcaattcatcatcaaaaagacaacaatggggaaggcgatgcgtgcggttgcggttgatccgcaggcggctcagttagtcggcattaatccggatcacgtcatttcctttactttcgcgttgggatcggcattggccggggcggctggtgtcatgatcgggctgtattacaactcaattgatcctttgatgggcatggtaccaggcatcaaagccttcgttgctgcggttgtcggcggtattggctcgattccgggagcggcgatcggtggcttcttgatcggtctgcttgaaaccggtgtccaggcaattggcttgtccgcttataaggatgcggccgtttatctggttctgattttagtcctcgtcgtcttaccggccgggttgtttggcaaacgtcaacgagagaaggtgtgagctgatgcttaaaaacttacgcagcaaattaatctggttggcgatcatggtggctggctttgtcttgatcgatattggcgagtttaccggaatcgtcaacagttttattgaaaatgcgctcgtcacgatcggtatcaacattattttggcagttggcttaaacctcattatcggcttttccggtcagttttcattgggtcacgccgggtttatggcaatcggagcgtatgcgactgctatcgtcacgcaaaatatggcgaccccgcttggcttttaccttgccatgctactggggatggtgattgccgtgattgccgcgttaattgtcggcattccgaccctgcgcttgcgtggtgactatctggctattgcaacgatgggggcggccgagattattcgcgttattatcaataatctgaaaatcaccaatggaccagcaggcatgttcaatattccgccgcttgcgtcttggcccacggtatacgtgttgatgtgtgttaccaccgtggtcattgtcaactttgttcatagtcgctcaggacgtgcgatcatggcgattcgcgatgatgatattgccgcagaatcgatcgggatcaacccgaccaaatggaagttggccgcgtttgtgttaggtgccgcaacagctgccattggcggatccttacatgctagttatttgcagaccattgcaccaggcgactttggcattatgaattctatttcactcttgattattgtcgtgctaggcggtgtcggtagtatgactgggacgtttgtggcggcaattgttctaggcgtgatcgacacggttttgcagaacttcgggacgttgcgcatggtcatctacgcgttggctttgattttgttgatggtctttaagccgtccggacttctgggccattatgagctttcttttagccgcaaacggcgcgcgcgaaaggaggcggcgtcatgaccaagcaattggtagtcgagcatgttagcaaagtctttggtggacttaaagcagtggcagatgtcagtttaaccattgatcaaggttccttgattgcgttgattgggccaaacggtgccgggaaaaccacgctgttcaacatgctgaccggcgaatccggaccgacaaccggtaaaatcacactcaacacagcaaccggtgccgtcgatattaccaaaaaaaaggcctttcaggttgctaaactaggcgttgcccgaacttttcagaatattcgactgtttggggcgatgtcggttaaggaaaacgtcttggtggctagaacccacctgtatcacgaaagttttctgggaacggttttgcgcttaccgcagttttatcaaaaagagcaggcagtcggaatggcggctgatgaattgctcacctttttcgaactcaatgatgtggctgatgaaccaactgccagcctgccatatgggacgcagcggcgagtggaaattgtgcgtgccgttgctactaagccgcaactactttttctagatgaaccggccgcggggatgaatcctgaagaaacggctgatttaagccgcttgattgctcgggtgcgggagcattttggcattacggtggttttgattgaacacgatatgtcactggtcatgaatctggcagagtatatctatgtccttgatcacggggcgatgattgctgaaggtacgccacaagcgattcagcgcgatccgcgggttatcagtgcgtatctgggaggtgaggtgcatgcttgatgtcaaagatctggtcgtcaattatggcgggattcaggcagttaaaggggtcagcttccgcgtgcaaaccggcgaaattgtggccttgattggggcgaacggggccggaaaaagtacgattctaaaaacaatttccggattgttacggccgcgttccggcactatcctgtatgaagacaagaacatcgtggggatggcagcagccaaaatcgtgaaaatgggcatctcgcaagtgccagaaggacgccacatttttgccgggttgacggtgagtgagaacttgcagatgggggcattcggactaaaggacaaacaagtcgccagtgatcaactggcggtcgtctatgatcggttcccggttttaaaagaacgtcgcaatcaagacgcggcaaccctttccggtggggaacagcagatgttggcgatgggcagagcgttgatggcccgaccaaaattactcttactcgatgaaccttcaatgggcttgtcaccgatctttattcaggaaatttttgatattattaccaagattaaaagccaggggacgaccattttgttaattgagcaaaatgctaaacaagcactggccgtagctgaccgcgggtatgttttagcaatcggcacgctgaagttaaccggaaccgggactgatttgctggcagatccggcagttcaggcgacttatctgggagcgcaaccagcgaccagctgaggcagataagatgttattttgcagacgagcagcgattggagctgctcgtcttttttataaaaaatattatatcgattgatgtacgcgtgtagcatgatatcggtagatcaaggacatcaacaccatcgcatctgctttggtaaccttgaaagggaggataaggacttgaacttaatcgcgcaccaacagtggctggtggacttttacgaaaagcgccactggtatcaatattcaccgttcattcggctcaactttctcacagaggaaaccggcgaattatcgcgggttatacgagccattgaaatcgggcgtgatcatccgggcaagccggttcaaaacgaagcggatctggaggctaacttaaaagaagaactagcagacgtgttggatcaggttttaatcttgagcgctaaatttaagatcgatcccaatgatttgttggcgcaaagtgaacataaattgaaggcgcgttttaagaaagatgtttgagccaaggtgattgcttcgatgaacagtgagcacttggattgtctgaaaagtgtccatagaaaaacggttccggcaaactgatgccggaaccgtttttgcgcggagcctgttagaggtgattattgattttgtcccccatcgcccggtgctggaccaacaccgcggccgctaccgcctgttcccggacgaacgccttgttgatttggtgttgcaaccatgtattgactgatcagactaacaatctgccggttttgcggcaaagcgctatggttggcatcatcgcctgagacggtaatctgggtataatgggcaacctgattttggaaaatatacttaccggcttcgacactttcgatcggcaccgtgccatcgccatccaacgtctcggttccggcaatcgagtaaacggttagactgctcggaagcttgttgcgactggttataaagtcattgagcatctgcgtccggttatccggattactttcttcgaggttatacggggtgccaatggtcattaggcgggtcatttgaacatctgaatcgttgtaatatttttctagaaaaagcgtgaaaatgagtccgccattactgtgaccgataccgcggaaccggttgaaattgtaagtctttgccagctgcttaaacgcaatattgaaccattcggcctgtttcttaatattgttgtaaccatctttattattttcaaatgccacaacgatataaggttcggtatcacgggctgcgattttgccactataggtcatggtgccatttgtcttcaccgtgatctttaaaagactatgaccggttgtttgcgcattgagttgcgtgattaacgtgttaaaacggtcttcggtggccgaactccccggaattaagataattggctgcattcgggaattgtgaaccacacgcgcagatttaacgttttgcgccatccactgagttgcgggaaacacgacagcacccattgcaagtacgctgagaacaagcaaaagccatttgcgccaatgtttaatcatgatgaccacccacttttgccgattcaagattgatggtttcggctaaccggacaaacgggacataaatgaagactgaaatgaccagacacaagactgcgactaataatgcgacaagattgccattggttcccagaaacgcgattaagggtccaggggttgtcgccgggaccgtgtaaacggaaggcggcataagatgcagtctgatggcagtccaggcaatggccatgttgatcagcggggtgattaaaaacggaaccagcatgatcggattaagcatcaccggccagccgatcagaaccggtgagctgacatttaccaaacccggaaacaacgataactcggcgatgcgacgtgatgcctttgaccggccgacccagagcgtggcgataatcaatgctaaggtcatgcccacaccgccaaagctggcaaacggacgataaatcgtgcccatcgtgattggattgggaacgttaaataaatcggcatgctccaacgcataattcaaattggcggttgccgtggtgctgcctgattgaaccatcaacggattaatcggaccttcaatcccggcccaccacatcaaagcattgatcgttgtgacaagcgcaagtcgcagtgaaacgtgggttaagtgagcagccgggaattgaaagaccacgtaaaagaggcccacaaacccttctgttgaaacaaaaccgagtccgtaattaatgaccacacagctaatgagtatcaggaccatcatccaggttccccgtaatccgcgactgacgagcccggcgatggtatagcgatgtgaaggctcttctaagtccgcccgcgtgaagcgaaaaagccaaccgatcaataacccgaaaataattgcaataaacaagccgcgatagcccagattgttcatttgaaaaactgattgggcattccggcgtgtttcaagattgagaattaaaaaggcaccgacgcttgtgacggcagctagagaatcgtccttcttatacgatcgtgcaacatacttggcaacaaaaaaggcagtcatgacggccattaaattaatggtgacattttcgatggcgatcaggagtgtgcgcatctgggtataaaaaggaatgaccttgttgagattataaatgacggcaaaaaaaccgttacgcgaaaaaacactcaactcaagcatttgtgcccatgcgccgatcacgacgaacggaaaaatgacagcaaaagtttgttgaagggcacgataagttcgagtttgccgcagccgaacactatttgctacgagcatcggaagcaatctttttgtgagattgctcatgactgccatctcccttgatttgttgaacacctattactgttattctaacaaatattattgtaatcgagtagttttatgacggacagggcggcgggtttggcaaacgagaagatgacacattgacgaacgtgacttgagcaatggcgatgggggttcacttgttacttttgttgcagcgtatgcaagtgactcgttaccatggtatccttaaagctggaaagcaaaagacgttaattagaaagcgcgttcataaaggcagtatcgctattcttgcgccacgtgaatacgcgcgtctaaagcatgatggaggcataaaaatggataagccattggcaaagtatattgatcacacgttattaaagccagacgcaacgcaagcccagattgatgtgattttggatcaggcgaagcaatatgattttgcttcagtgtgcattaatccttattgggttgtgcgggcagcagccagtctacgcgacaccgatgttaatgtttgcacggttattggtttcccacttggcgctaacacgacacagaccaaagtatttgaagccggtcaagcagttgacgaaggtgctaaggaagtcgatatggttttaaatatcggtgaactgaaagctggtcatgatgatcatgtccgcgcggatattcaagcagttgccgacatcacgcatgcaaaaggcggcattcttaaggtcatcatcgaagcagttctattaactgatgatgaaaaagtgacggcatgcaaactcgcagctgcagccggcgctgatttcgttaaaacgtcaaccgggtttgccgccggtggtgccacggttcatgatgtcaaactcatgcggcagacagtcggtgatcaattaggtgtcaaagcggccggtggtatccacacctatactgaagccaaagcgctcattgaagccggcgccgatcgtttgggtgccagtgccggcgtgcagattttaaaggaagcaggggaagcttaagatggcttttgatcgaatcattaccattgtcttagattcaattgggattggcgaagcaccggatgcggctaaatatcacgataccggtgccgatacgcttggtcacattggcgattattttgccgggaaattatcgttgcctaatttacaggcaatcggtctgggcaatatcgaccgccctacgccaattgctggggttaagccattagggagtccgagtggttattttggcaagatggccgagatttcggctgggaaagatagtatggatggccactgggaaatgatgggtctgccggtgacggaaccgcttggctattttcctaatggattcccggaagacttgattaaacaaattgaagaattttccggccggcatgtcatcttaaataagccttattccggcaccgaggcgattaaagactacggtgaagagcagctgaaaaccggtgatctgattgtttatacgtctggcgattcggtcttgcagattgcggctcagactgatgttatccccttagaggaactgtatcggatttgccgttatgtccgcagcatcacgattgacgccccatatcgcatcggccgggtgattgcgcgaccgtacgtgggaaccgatccgacaacctttacccgtaccagcgatcggcatgattatacattgaaaccggataagcccactgacttggatcgcttgcagggagccggtgtgccgacatatggcattggcaagatcaatgatattttctccggacaaggattggatgatggggtgcacacggttagcaacgtggatgggatgaatcaaacgattgccgccgtaaaatccgatcgcaaaggctttattttcaccaatctcgtggatttcgatgcgatgtatggtcatcgacgtaatgctcaaggcgatggtgacgcattaatgacatttgaccaccagttaagcgatttgttgacggtgttgcggcgtgaggatttgcttatgattacggccgatcatggtaacgacccgacatttcgcgggacagatcatacgcgcgagttcgtcccattactagcatatagcaaggcattagccggtaacggggatctgggtatccgttcgccattttccgacttaggggccaccattctcgacaatttcggggtcaccgggaatcgggtaggtcaatcgtttttgagtctgcttcgctaatgaggctaggatccggtagttgtagttgcaatcaatccggatgatgacgggtagccatctgacggttgtcacttgcttgtcgttcatttgtcgacccgaatccaactaagggggaattttcatcatgagtacacatattgacgctccaaaaggcgccattgcagatgttgttttgttaccgggcgatccattacgcgcacaatatattgccgaacattttttggaaaaggctgtccgctacaatacagtgcgtaatgcctttggttatacgggcacctttgaagggcgacggatctcagttcaagcgacggggatggggattccttcaatttcaatttatgttaatgaacttattcaggattatggcgtcaaaacactgattcgagtggggactgccggtgggatgggtagcgatgttaaggtacgggatgtcattctggtacaaggatcatcgacagacagcagcatcgttttgaatacgtttggggcggggatgtattttgccccaatagccgactttcagcttttgcgtgaggcagcaaatttggcagatgctggggcattgcgctaccatgtgggtaatgtgctcggagaagatcgcttctacaacgatgaaatggatcgtcaaaagctcatcgattacggcgtgttagccaccgaaatggagacccctgcactatatcttctggctgcgaagttccatgcacaggcgttatcaatcctcaccgtctcaaatcacctgatcaggggtgaagaaacaacggctcaagagcgtcagactagctttaatgacatgatcgggttggcactgggcgtcgctaaaaagattcctgtacgttaaataacgtataagttgaaggcatacctgtgtaaaatgacggtttaaaattttccggaaatagcaaattaatgtgcgaagaagtaggaaacgtgttattctgtatatggtttcttaagaaaaggtaaatgcaaattaaagtgtaaatttagattcgtacaattattcagtttagaaatggaggagtacatacatggtagattctaagaaagtattgtcagtaacggcaggcttcgttggtgctgccggtctggcggctttagcaaccggagccaataccgtttctgcatcgacagggacggtcagttacaaatccggtgcgaccaccgtatggaatagtccatcatggcaccaagtcaaacgctacgtgacttttggggacacggtgcagctattgggtaaaaccgttgaccaaaatggtgctacttggtataaagttggcgacaatcagtggattccggaattgtatttgaatgttgcgggtaaaactgccacggttgaaacaccgagttcggcagcaagtcaaactgctgtcagccaagcaccggctagtcaggcgcctacaagccaagcaccagcaacccaaacacctgcagcaccacaaaccgatacccaaacagctaatacacagctttatgtcaagaatatcggttcagcagttaccgtatggacaaccccggcgtatactcatgcgacaggtcaatatctagaaggcagccagacactgacggctgttgcccagcagcaagcaaatggtgaaacatggtatcggcttgccaacggcggttatgttcctgcacggtttgttagcacaacaccagtggctgtaacaccacaacctgcagcgccacagtcaaatgaggccagtgttgcgtcaacgaacaccaatgcagctaatgattctgccgctgcttctagtgcagccgcatcgcaagccgcagcttccagtgctgccgcttctacagcagcagctaatgcagcagtagcatctgcaaatgccactgcatcacaagcagcggcttctgaagctgctgcatctcaggcggctgcatcacaagccgcagcgtctcaggctgccgcatcgcaagccgcagcatcacaagctgcagcgtctcaggcggctgcatcacaagccgccgcttcacaagctgcagcgtcccaggctgccgcatcacaagcagctgcaaatgctgcccagcaggcgccggctaaccaggcaaatgttacaacaacacaggttaatgccaatcaagctcaacagcaaaccgctacggctacaccagcagttaacacgtctaatcagacggcggccgtaagtgcttcaagacaggccaagattcaagcagtgattgccattgccgaacaacaagttggtaagccatacgtttggggcggtaaggggcctaacagctttgattgctccggtttgatgtattacgctttcctgaatggcgctggcgtcaacattggtggctggacagttcctcaagaatcttcagggacacaagtttcactgagtgctctgcaacccggtgacttactcttctggggtagtcacggttcaacctatcacgttgccctgtacatcggtggcggcacgatgattcaggcgccacagccaggtgaaaatgttaaatataccgcgctggcatacttcatgcctgactttgcggttcgcccgtcactataagcttaatgatcgaatgaagaatgcaagaacatctctgagtcgttagaggtgttcttttttatattaaaaaaccagacagttccgcggctcttagtggctgcatgaactgtctggttttgtatacatgacaaaatattcgtaaagcgagttaggctaccggtgttgtcggcttctttttagccttgtcaactgccgccatagccacggcatttacccagttaatcggctgatcgaagttaggttggaagagcatgtcaaccatcgcaagtgtttcgatcgtcatgtgggtctggatcgcaagcgaaatgacattagcgctttggctgatatcgtgcttggagaaaaaggcacctcctttaacttcatgcgtcttgggatcccatgtcaggctgcagagcaccggcgttgtggttaacatgaaatcggggcgataatcctgttcgatcgtgacactatcaagctcaagtccacgtgtgtgagcgccttccaccgttaggccgcttgccgcaatggcgtgatcaaaaagttcaacggccgagctagattgtgttcccaggtatttttccgtgggggtcatgatatttttaccaacaagaatgccttgacggactgcgttggtcgcaagcgggatgtagtcatttttgccagtcggattatagtggacggtagcggtatcaccagcagcgaaaatgtcggggtcactggtctgcatatatgcatttgttatgacagcgccattaggcagggtgtccagatggtcctttagcagatccgtgttcggacggaagccggtacataaaattgcaatatccgcggtatagtcgcctttattggttgtaaccttgataccctgatcagcttgtgcgaactcggtaaccatctcattgagtgccaagtgaaccccgtgatcggtgtaaagcttttcaacgcgatccgtgatagtggcgtcaaagtttttcgccaaaacccgtggaagtccatcgattaacgtgacttctttgtcggttaacgcaaattgttcggctaattctgcaccgatgtagcctgcaccgatgacaatggcgcttttaatggacggggccagatcttttagcgtcttggcgtcggaccaatttttgcataagtagacgtttgaatcgtggataccgggaatatttggaatgattggcgtcgatccggttgtgtagactaatttgtcataagtatcggtagtaacggttccggtttttagatccttgacttcaactgttttagttgctggatcaatattgagcacatcatgttccatttgcatattagcaccgagtttagcgagtgcttcgggactggaatagaacattttatccgggtcactgacatgatcaccaacccacaaggcaatgccgcacgagaggaaggacaggttgttattgcgttcgtagacagtaacctctgcatctggatggtcggttaggatctgctgggttgcaaatgtaccggcatgggtagcaccaatgacaagaatcttcatatcgcaatcgctcctttaaactattgataaaaatttcacaaacgaattataacataattgattgtgtcatgctatattgcttgcgatttattttgtgaagaaaaagttaagaagcgctttcacgatattgtggtctgctgagtatcagtggtgtttagatgctgagatgccaagttggcgcatgatggttggagcgcaatctttcgacttgtagtcccgtactgggatatatcaaataggagttgaggattccagccacctgccaatcatttccaaatgatgcatcaattgaaatctacgcacaactcccaaccccggaaaatgatgctgcgcggccgctgccatcaaagctttcgttccgagcgtctgtgcatcgggatggtgtggtaaccacgcagccagctgcaccagaatttcaaaaaatttggcttgcgggttggtgaagtcgtcattgttgactgaaacaaaatgatgcagacgcagggaaccatcagctgccgggtaaacaaggtggatggctaaggcgcgctgcggatagccatgctcgaaataatcagcagtggcgagcgggtaatccgcaaagccgatgcctggcaacatcaacggcgggtattggtaaaattcatcttgcagcagcccgtaatcagatgtgtgtggataaacggtgaagtgatcatttaaataaaccgcgtgtggcaaagctaactggcgcacccgagcttcatcaggcaccaaggccagctggcggcgcggcaataatttggcttgggcggctgtggtcgcaataatcaaaggcgctggttgggcatcaaaaatccgcgcctgctgaacggtcccactgacgtccggtaaatgacgcggggttgccaatagacgatacgtcccgacttgcgggttttgaatcacataagcggcgtgctgggctcggctaaaggcacgggtagctttggtaatgccggggatgtcttttaccggctcaagaattggcgtgaccgtggtgggcaggtgctggcgggtgagcaattccgtgatggccgctaagtcgaattgtttgccgcggataattggaaaatagttcatgataacctagccatttttaaagttgcgagttcagccgtcaatgcatcgatttcttcttggagcgccgcgatcgttgtgttgttgagttcatcgacaaactggtcataaagatttttgtcgggatgataaatgtcataatctgccgttcgtttgcgcagttcggtgaacaagtccgcggttgaaaattgcccgagtcccttggcaacctgctttgctttgacgacttcacggttgagactggcaatgaagcggtcggtgagctgatcttctggtacttgcagagtttggcggcgcgcaggtttggcaatcgtcaacgttcccggcgtcaccaccggcacggcactggctttgatggcggcttttgaaaatggctggtagaccaacacgccaatcccagccgaaatttcggccgccactgctttgtaaagccgttgggtcaaaacaaaatagttataatggccgacaaaactcaattgggcatgactatgaaaatctgctttagtgacttttaattcaaaacaccgccaaatcgtttcggactgctgtttttgccgcacgagggtatcgacaataccgaagtcgtccggcatcgtgacttcttcgactgcagtagcgccttgtgcttgccaataagcgtaaagtgtcgtttctaagtcacgcgtgagttgggttttcatgatgggcctcccaaaagtgtgtcagtaattgtgctaattgcgtgggattgtagctaacctgggcgtgggtccagtgatcaggaaacagacgggcataacgcggggtgataaagcgttcatcaatgagcaggattacgccgacatctttggccccgcgaatcacccggccacctgcctgcaagacattgttaaagcctggcagctggtacgcgtaggcaaagccctgaccagcatcgtgatcaaaatatgctcgcaactgatcggtttccggattgatgcccggtaagcccactgacacaatcgccaccccaatcaattgcgtccctttgaggtcaatcccttcagcaaaaatgccgccaagcacagcaaaaccaatcaccggctcactgccagccttaaagtgatcaagaaatgcttgccgctcactttcattcatggcattttcctgaacacaggttttaagatcgggatttgccgcagtaaacgcctcgtgagccattttcagataggcataagatgggaaaaagaaaagataatgcccggctttagccctgaccagcgtggtgagacttgcgatcagctgcggtaaatcctgcgtgcggcggcggtacgtggtgtggacactcgcatcgacaatgatggcctgattgtccggcgtaaacggtgatggcaaggtgtaagcaaggctatgttcagcgcctcccagtaacttttgaaaatacggcatcggtgataaggttgccgaaaataaaaccgcgcctcggccctttttcaaggcatcatcgacaaaatgggacgggtccagacagagcattttaatcataatcgtgtcatgttccttggcaatctcggttttgaaggtatcgtcataaaaatcaccaatacgtaaatactgattagcgagaaaaaacactggtaaaacaagttcgacagcaggctgcagcgcgggggtgggcggttctgccagccagtcgtgaaccgtttcggtaaaccgggtcaacacctgcgctagatcatcgagcggtgctgcttgaaagatcagtgactgcccgttgagtagctgatcagcaagggtattcatcgtggtgacaattcgcgtcatcgtccggcgtaccttggttaatgcggttcctttgaacggggcgagggcttgtttgaggttgataaagtcctgattggtcaggcttgcggtatacatatcgcgcgcccggctgacaagattatgcgcttcatcaaccaggaaaaactgactgtcatcggcttcactgaagaatcgctgcaaaaaaaccaagggattgaataaatagttgtaatcacaaatcaccacatcacaaaacaaactggcatctagcgaaaattcaaatggatccagtgtgtgtttgcgagcataggattcaatcacagatcgggtgagttgatcttcatattccaaaagatcatgcagtgcgggtttcaggcgatcataatagccaagcatatagggattttgactagggtcatcgggctcatcggcgaaggtaatcgtgtctttagctgttaaggtgatgctttttgccctaagtccgacgtctgccatcagcgctattgcctgttccgccacccgacgtgtactttgcttggctgtcagataaaaagcgcgctgaatcaacccactacccatagccttaatggtcgggaaaagcgttgaaatggttttgccagtaccggtgggcgcctgcacaaacaaacgcgcgcgactgtatatggctttgtaaacagcggcagcgaactcgtgttggccagtacggtactgcggaaacggaaatttgagtgtggcgatagaagcatttcgctgtttaataatatcgctgcgcagttttaaccaggcagtgaattcgtcaagtagatcggtgaaatcatcagctaactcggcggcactttttgtttcagtgaagcggctgactgtgtcggtactggtttgaacataaaccaaggtgataacagcatggtcttgatgccgctgttggcaaagtaggtggccataaatccgtgcctgcgcccagtagcgatccttcgtgttttgcgaacattcttcccatgaacgggcactggttttaatttcttcaacggttagcgtcttgttttcggtccaaaccccatcggcacggccttccagttgataatcctcgtcattgacggtaacggtggtttttaaatagacttctttttcataatccgattcccgatgcgctgcttgaagcttgcggtgaatctggctgccgatcatggcggtgttatttgagttactggtaaccggatttagatcaccggtacgaacggttaactcgacaaattcgcgaatcccgatacggttatgagccatcagcgcacctccttgtgtgagtatgattagcttttagtatagaacatacattctgtttggggaaattgtgggtgggattccggttgtttctttgcttttaatagaattagaggcataataggggtgtcaagacatatgacaaatacggcggcttgcaaacactgtcgatcggtaagccgcgacatcaaatgagggacatatgatgaaaaagacaagtttctggcgtttgttagggtttatgggcgcgattttattgttattgaccgcctgtggtaagcaaggttctgcggcaaagtcgtcgtccagtgcaccggttaaaattacatactggcatcggatgaccgggacttatgaaaagtcgctgaataagttgattaccaaattcaacaatagccaaaagaagtacaaggtggtcgcgacctctcagggttcatacaacgccttgcaacaaaagatcatggcggcagggaaatccaagacgctgccaaccatggcccagtcaccgtatacaaatatcggtgactatgtgaagaatcagttgttgttgccatttgattcggaaatgttaaatggttcgaataaattaagcaatcgtcaattgaaagatacttacccaagctttttagcggcgggcaaatacgacggtaagtactatggcttgccattttcagtttccacttcggtactcttttataacaagaagttgatgtcacagtataacatcagtatgccaaagacctgggctgattttgcggcggatcaggataagctaaaagggaccgatattaacgccatcgagctggatcagagttatgatgtggccttggaagggatggcttatggtgctggcagtcagctgattacgccgaagttgaaggccaacttgaatgcaccgaagacattagccgcggtgaatcagatccttgatttgcgcaagagtggtgccttgaagaccgccggcgaagaccaatacttcagtgtgccgtttgcaaatggcaaggccgtttttgggattggttcctctgctacggttccggtgttgcttcaacaggcacccaagagtcttgattggggtaccgcggtcattccggaatacgaaggcaagcgcagcaacccgctcaacgggaattataatgtgcttttcaaaggcgcttctaaagcgcaacaagccggcgcctgggccttccagaagttcttgctgaagtcggaaaatgccgcacagtgggccaaagcttccggttacgtgccagtgactaagagtgcgtctaacagtgccaccttcaaagcctatctggaaaagaacacgcaatacaaagcagcagtttcagcagtctcgcaaagttttgcctccactgtttttgccggttacaccgactatcgcaacgatttgatgagtaccgttgacagtaccttgaccaagaatgtcagtggcgaaaccgcctttgataatctacaaaagcagaccgacaaaattttagaagaaaataaatagttttttaatcagccagtaataccgcgatgtgttactggctttttgctgccatgtcggtaaacaaccgtctgtcgctgccgatgtcatgatgcggacatggcgcaaaacagtttacgtcattgaggtcggatttgcgccgtattaccttagtgggctatgatggtcaaagcattgttatgcattaaaggagaccgatatggaaatcaatgtacacaaatttcaggaagctattttggccggcactttcgaacacacagcagttcacgtcactgctgcggcattcaagaaagacggcatcactgacgcactgacaaaggtttttgcagatgtccgcgcggcgattgagaaggatcaattgattcaggcggatttggtggttgatttccctgaaccgacaaccattaccgttgagaccgggatcatcaacctgccatttgcgaatgttaataaaatccctaattttctggaaccggatgaaattgttccggtacgggtttatttaattgtggcatcaccttttgtcaacgtatcaggtttgcgcattgatgaagccgcgactgccgctgattatttgcaggattttgacacgatcaatgcccaaatgacggcctcagttcaggaaaagcttgaacacattcaaaccgaaatggccaagccaaaagaaaccgttaaagaagtgcccgccaataagcaaaagaccacggctaaaaaaaccacgcggcgagcgacgaccaagaagaaaacgaccacgcggaaaacaaccaagaagtcgactagtgcacgtaaggcggcgcccaaacgtacgacgactaaaaaaacgatgacacgtaaaactactaaaaaatagccttttagcgactagtgatcattaatttgatggctagtttttcttcctcagcgtaaggtaaggatacactttttaaaataggtttaagcccgctgttctggctgggggcctttttgcgtacgcaccaacagagacttacagctgctaaataatgcaaaacagcccgctgcgcatcttttgcgtaacgggctgtcgattttcccaacgccatcgttcattatggcgttgaatcgcaacagcgcgcgatctcagtgggcatcttttactatttttaactgttgttacatttagttaagagaacgaatgattggcctagggtgatcgtgtataatgaaaggcgaaaccggaaaaagtgcttacagatagtcatgatgactggaaaacgcgattgaagaggagtggagcttttgacagaaccattgtttttgaagccatattttaatcccaagatctggggtggccgtaaacttaagactgaatacgggtttgatattccggacggcaaaatcggtgaagcgtggattatttccggacatccgcatggaccggcaaccatcgaaaatggcccactcaaaggcaaaaccttgcgtcaagcctggcacgaagatccggcttactttggcccgcaacatagccaggaatttccgctgctggtgaaaatcctcgatgctgaagccagtttgagtgttcaggtgcacccagacgatgcatatgcagccgcgcacgaagccaagggcgaacttggtaaaactgaatgctggtatattttgaaagcggatccgggcgcctacttaatttatggccaccacgccaaaacacatgaacagctcaaggaaatgatcgaagctggcgattgggagcatctgttacgcaaatatccggtcaaaaccggcgacttcgtttatgtgccaagcgggacgattcacgcacttaacaagggcattgtcgcattggaaacgcagcagagttctgacacgacttatcggttgtacgactatgatcggacggatgatcaagggcacaagcgcgagttgcatattaagcaaagtcttgatgtgaccaccgtgccattccatgatcctaagttgcacattaccaaagaaaatgtcacaggtggccaaatcactacatttgtgaaaccaccattatcaccgcattttgccgtctatcggctcgatgttgacggcactatgtcatttacccagcaggcaccttataccaacgtgacggtacttgacggcaccggtacctttacggcagatggcaaagattatccaattaaaaccggcgatagtttcttgattcccaatcaaattaaaacctggcagtttaccggtaaacttgccatcgttacctcaacgccaggtgccgatgcgtaacagttgagtttctggtttcagacaggttaaccattcaaacagccttggagacgaaaaatctctgaggctgtttttgactgttcagacattgcattttcactgaaaagtaatttttagatcatgaagacagtctttaggaagacggcaaaaaattaataaaccatgagagtgctttcttattgattattttatattaaaacgttggtctaaggtggtttagcaaggctacttgactcatatgcgacggattgaaaagcatctagcgtgactggtatggactagggcaaaaccgcagtgcgaagccgccaaattagaattaagtcgtttccattgacaatcagagctgcaaacgcatacactacatgtggttggtaccacgtggaggtgaggatatggaaaaggttccgttgaccaaacagctggtagatcagttggagacattcatcaaagaaaaacttcagcctaatgacaagttgccgtccgagcgggatctgagtgaactgtatcatgtcagccgcaatacggttcggtccgcgttgaatgagttatttctgcgcgggttcatttatcgcagtaccggcaaaggcacgtttgtcgctgaacggtttgacgaacgaacggatgtaagcggatcgtacagttttaccaaacaaatgctagccatgaatcgtcagccagtaacgaagattcaacgactggaaaaaatcgcggtaccgcctgacattgccaaacggatgcgggttgatccagagacaccggtttatgttcttgaccggttgcgaattgcggatcagttgccgatgatgattgagcgtagttacttaccggcgttgacggtgccggatctgcaagcatctgatttagccaaaaatccactatacgattggctggaacagcattatggcattcacattgcgtcggttgatgaagctttttttgccgggctggtctcgccggaggatgccaaacagctgcgagttgcgccggcatcggcatgcttaaacattcggcgaacgacttttgccgatactggggaaatcgttgaatatacgttgagtgtggcgcgcgcggatcaatttgtttatcacgttcatcatgtgaatcactagggaggatattattttgttcgaaaaaacgacagaagaattaacgaaaatgggtgctcagattaccacggctgagatcaagcagcagccggaactgtggcaagaagcgtttgctaattatacgcgtgacaaggaaaagattacggctttcttgaagcaggtaaccgctgctgcaaatggtcagaccgtccgggttattttcaccggtgccggcagttctcaatatgtgggtgataccgttacaccgtacttacgggcgcatggtgatcgcagcaagtttgaatttgaatccattgcttccaccgatatcgtttctgcaccttatgactttttggaagccgataccccgacgattctggtttcgtttgctcggagcgggaactccccggaaagcctgaagaccgttgagctcgcggaacaagttgtgcataatctccatcagatcagcattacctgtgctcctgaaggccaattggcaaagaaatccgctactgaagataagaccttgttgctgttgcagccagcaggttctaacgataaaggctttgccatgaccggcagtttctcatgcatgacattgagtgctttgcttgtttttgacgctgccagtgatgatgacaagcgtcaatgggttcaggcaatcgccgcgatggggaaagaagtcgtagcgcgtgaagctgaaattcaagcggtattggatcaagactttgaacggatcgtctatcttggctccggcagtctcggcgggttgacgcgtgaaactcggttgaaggtacttgaactcaccgcgggccaatacgcaacgatgtttgacacctccatgggcttccgtcacggaccaaagagcttcgttaatgacaagacactgttgttcgacttggttagcaacaatgcttatacccgccaatatgacatcgacgtgcttgaagaagtcaaagacgacaagattgccccttctgtcatggcagtcggcaccaagcaggatcagaacttctcgggtgacggtttctactttgaaaatggccttaaggatcttccggaaggctaccaagcattgcctgatgttatgtttgcccagactgtggcacttttggcttccatcaaggttggcaacttacctgataccccatcaccgaccggcaccgttaatcgcgtggtaaaaggggttatcctccacgactattcaggtcaggaataaggttgcaactgtcatggcgccatttagtcgagtaaatcggttggatggcgttgctaaaactgggaggcaagtgttcatgagttattacattcacgccgcaaaattctttctcaaacatgtgactgaaattggcgggtatctagaagtgaccgatgatggccagtttggtcaatatttacctgaaagtgccaaaccagaaggcgaaattgtggaacaaccaggcaagctaattgcgcccgggttggttgacacccacattcatggccttttgggacacgatgtcatggataacgattgggacggcatcaataccatgagccagaatttgctcaaggcaggcgttacaagctggctacccaccactttgaccgggtccttcgatcagctaaacgatgtctgcaaaaccatcgcggctcatgcaggcgaagaatccggcgccaagattcaaggcatttattttgaaggcccatacttcacaaccaaacacaaaggcgcacaaaacccgaagtatttcaaaaatccgagtgaaaaggaatacgatgcgtggcaaacttcggccaatggtttattgaaaaaaatcgccattgcgccggaacgtgacggcgcagttgcgtttacgcggtatgcgaccggagatggaacagttgtggcgctgggtcatagtgatgccacctttgaacaggcaaaagcttgtgtcgaagcaggtgccactgtcttcacgcatacctttaacgggatgagcccactgagtcatcgggcacccgggatggtaggcgctgcaatgtacctacaaggcgttgatgacgagctgatttgtgacggtcatcatgtgcggcccgaagttgcgaccacgttaattcggctaaaaggcgcagagcacattgctttgatcaccgattgcatgcgcgccggaatgatgcctgatggtgattatgtactgggcgaattcccggtttacgtcaaggacggcatggcgcggttaaaagatggcgacagtttggccggttcggtgttggaactaaaagattccttgacgaatctcttagcttggaacgcagccacgccggaagccattatccgcatggcaacccaaactccggctgcttcctgcaagattgacgatcaatgtgggagcattttaccgggtcgagctgctgactatctggttttggatgctgacttgaagctgcaggcaacctatctcggtggaaaacttgcgtatcaagcagaagcatgacagctttcctgacacaaaaccttgtgaaaaatggcgttaatgtgtgacactggattatggcaacggaacgggtgttatgaatcgttttgggttgccatatgcgcgccgggtcacgctcaccataacgcgttcaccggcgcagaagtctgcgtgtaaggaccttagccgcaatggccaaagcccggccgtcacgtctaaggccacttacactccgacttctgagcgcgccggatcacgctcacactttggaagggaggttaaggttcgtgacgaccttttcgatcgatcatgaatttatgttggatgggaagccgttcaagatcctatctggtgccattcattattttcgggtgcatccgagtgactggtatcacagcctgtataaccttaaagctttagggtttaacacggtggaaacctatgtgccgtggaacttgcatgagtatcgtgaaggcgagtttgattttagcggcatcctcgatattgaacgttttctcaaaactgctgaagatctcggcttgtatgcgattgtgcggccgtctccttatatctgtgcagagtgggagtttggcggatttccggcatggctgttgacgaagaagatgcgtctgcgtactgatgatccagcttatttggcggcaattgaccgttactataccgcattgatgccgcatctagttgatcatcaagttacccacggcggcaatgtgatcatgatgcaggtggaaaacgagtacggttcttatggtgaggatcaggattacttggcggcggttgcgaaactgatgcagcaacacggagttgatgtgccgttgttcacttcagatggaccgtggccagccaccttaaacgccgggagtatgattgatgccggcattctggcaacgggcaacttcggctcggctgccgataagaatttcgatcggttagccgcttttcatcaggaacacggtcgcgactggccactgatgtgcgtggaattctgggatggttggtttaaccgctggggtgagccgattatccgccgcgatcctgatgaaaccgcggaagatctgcgcgccgtcatcaagcgtggcagtgtgaatctctacatgtttcatggtggtacaaattttggcttcatgaacgggacgtctgcgcgtaaagaccatgacctgcctcaggtaacatcttacgattacgatgccccgctaaatgaacaaggtaatccaacgccaaagtactttgccattcaaaaaatgatccatgaagagcttccagaagttcagcaagccaagccgctggtcaaacccacgatggcgccagcttcacacccgttaacggctaaagtttccttgttcgcagtcttggatcagttaaccaaaccgatcgccgcttcttatccgcagacgcaagaatttctgggccaatataccggctataccttgtatcgtacgcagccgctcattagtggcactgacaaaggaacaccggccaagttgcgggtgatcgatgcccgtgatcgggtgcaagcttatttggatcaaaaatggctagcaacccaataccaagaagcaattggtgatgatatcttgttgccggaagttgagggacatcatcaacttgatttactggtagaaaacatgagtcgggtgaattacggatccaagattgaggcgatcacgcagttcaaagggattcgcaccggtgtcatggttgatctgcacttcatcaagggctatcagcaatacccgctggacttgaatcgcgcttctcggcttacctttacggaaggctggcagcccgcgacccctgcgttttacaagtacacgtttgatttgaccgccccgcaagatacctatcttgattgtcgtggattcggtaaaggagtgatgctggttaatggtgtaaatgtcggcaggttttgggagaaaggccccacgttgtcactttatgtaccggcaggactcctgcacgccggaaaaaatgacgtcattgtgtttgaaaccgaaggccgctacgccgaaagcttgaagatggctgaccacccgatatttaaagaaccatgatggataacttccggtgcaagctccaaaccgcaccggctcacgctcacagacacagaaggaggagtagaaaatggctattattgctgcacggattgatggtcgcttggttcatggccaggttgccaatctttggaccaccaaactgggtgcgactcgaattatggttgttgatgaggcagcatccaagagcgacattgataaaagcgggttgcggatggcgactccggaaacggtacgcttatcggttctggatgtcgcaactgccgcaaaccatattttgaaccacaagtatgattcccaaaaggtgttcattgtcgcaaaacgtccagaaacattccttgctttagtcgaggcaggtgtaccgattaaggaattgaatgttggcaatatgtcccagacagataaaacccgttccattacaaaatcgatcaatgtggtcgatgaagatattgaaacgttcaagaaactggacgctcacggtgttcacttgattgcacaaatggttccgggtgatgctgcagctgactttatgtcattgctcaaaaaaggatagggggagtcaacaatgattgcatggtagcaaatagtgattataacattatacgcaggttatcaaattcttgatgaactgcaaatttattcagccatgagttcatcagttttcgctggcttggttgccggtctcgttatgggtgacatgaaggccggcttgctaatgcatccacccagttgatggttctaggggttggtactttcgggggtgcttctaaaatcgatgcaaactccggtaccttgttagcaactgctttctctgttagttccggtatgaagccggaagctgctgttgctgcgattgcggtaccagttgctagtatcatgattcaaactgatattcttgctcgttttgcgaatactttctttgcacatcggattgataaaatggttgacgagtataattacaaaggcatcgaacgttacttccttgccggagcacttccttgggctttgtcacggatgattccagttgggttggcgttggcctttggtggcggttttgttaccaatattgcccacgcattgaacaccgattggaaatggttaggcgatggcttggcaacagccggtgcggttctgccagctgtcgggttcgcaatcctgctccactacctgcctgttaagaagcattttgcttatctgatcttaggctttatcttcaccatgttgttcaccaccttgtttggcaatattcagacattgggaacggcagtcgctggtgtggctaagaactttacagcgacattcaacggcttgtccatgctcgcaattgcattgattggatttgcgtttgcagcgatcagctaccagcagtcaacacaactgcatgacagtgtcggtggcggttcagaagccaatggtggtgctaaagcagcaaagaagactaatgatgagggggaaatcaccgatgatgaactctaataaacccgcttacaaattaactgacaaagattttcggcagattaaccgtcgtagcttgttcggcttccagttgggttggaactacgaacggatgcaggcttcaggttatctgtacacgatcctgccgcagttgcgtaagatttatggtgacgggacgccggaactcaagaaaatgatgaagactcatacgcagttcttcaacacctctaacttcttcaacaccattatcaccgggattgacttggcggttgaagaaaaagaaggaattgccggtgaagaaaccgttgttggtatgaaaaccggtctgatgggctcctttgcttccattggtgattcaatctttgctgctttgattccggctattttcggggcaattgctgcgaacatggcggaaaaagggaacccagtcggtatcttcatttggattgcagcccaagttgccgttatggtcttccggtggaaacaattacggattgcctataacgaaggggtttcgttggtcacaaccatgtcgcatcggttggcagctttgaccaatgccgcaacgatcatgggggtcttcatggttggcgcgttggttgcaaccatgattaatgtgaaatttgcatttgcaccaaagatcggcagtgtgccactgaacttccaaaacagtgctgacatgatcattccaaagctactcccggctttgatcgttggtgccgtttattggttgcttggccgtaagcatatgacgtcaacccgggccatcttcattgtgttgattgtgtccgtggccttgtccgcacttggcgttattacaaaaggctaataaataacctgccgaaatgtttagcacgaagcatgagccaatccagccatgttcggcgtgtgagcatcaaatggttacgcggtttcgtcacaatgaagtgcaaagcgttggatcagcgcatgttaaaggagttttggaaatatgagtaagttagttttgattagtcacggtcaattatgcgaggaactcaagaagagtgccgaaatgatcatgggtccacaagatgacattgccacggtagcattgttaccgaatgaaggcccggaagattttcaagccaagttcaaagcggcaatcgaaggtgaagatgatgtcaccgtcctagccgatttgaaaggcggcacacctaataatgtggcagcacgggtgttggcagaaggcggcaaatttgatctctatgcaggcatgaacctgcccatggtgatcagtttcctcaacgcccagatgctggacatgaagccggatcttctaggagacggcaaggccggtgtggtttatattaatgatattgtgaagcattaatttggttcacaaattggaaagtctgtgtccgttgggatgcaggcttttttggtactgctaaaaatgcttacgagtgccgcgctgggaacaccccgattcgagctaagagggctgaatcgtaacctgattaaagtagatttgaaattgtgctgggtcgacaaagccggttgtggcttgcatggtgtttaacattccggtggtcatagctgttttcagaatggtctgatcagactgcttgtcgtggatacccatggcaagcccagccaaggttgcatcgcctgaaccaactgcattgaccaccttgatcttggggataacggcatgatagaagttctgcccatgctttgcaaaagcgcctgcagcccctaatgaaactaccacccaatcgacaccagcaaagacaggcgcctgtaggtcttgtttgagtgttgaaagatcatttttgtcaacatggtgtttaagcaaatcgctcaattcctcatcgtttggtttgattaggaaaggcttaagtggcgcatcaagtgcatgcgtcaaggtggcacctgatgtatcaagtaaaactttgacaccttgtttttcagcatgagcgatcatcaatgtgtagtaggtctcgggcaatccttgtggcatagaaccagagatagtgactagatcggcttctggcagcaagtgatcaaaatgatctaggaatttattagcgtcttttctatcgatcgttggtcctgcttcgagaatttcggtttgattcccgttatcatgtaaaatggcaattgagctacgtgtttctgcctgaatagacaggaattggtgagggatgccctcgttatcgagctgatgctgtagccactggccaaaataaccaccgatgaatccagtggcaaggatatcgtgatccatttgatgaatcacccgcgaaacattgagacccttgccaccagctgttttgcgcacatttttaactcgattaacagtattggtggctaaatgctctaaagggtatgaaacatcaattgagggatttaaagtaactgtcaaaatcataatcttggcctccatgacaaaagtcgattcgatgaagaatcgacttttaattgcttgaatccaaacaggtgagcttgaaaattttaatgacgtttggattgcttgtcgaacgattaaagccattttttgtaggtggcttttacagacataagatttgaaacattgaatatctttgcgacattatggttaccgaaccttgtgtaacaatagtgaattagccgcgggactttccgcctgaaacattgactgtttggccagtcatgtaacttgagcgatcagagaggaagtaggtaactaaatcagcaacttcggaaagtttaccgctgcggcctagaggaattgtcgaagtctttgcataacctgctcgtagctgttcgaccgtctcatgacgtgagtaagcaagtccttcttcgtaagaaagcgtacgtagaccggtggcttccagaacaccaggcgcaacaccgatcatgcgaacattgtattgacccaactctttagcccaagcgcgagtaaaaccattaattgcgccttttgtgccagaataaatgccggcaccttgtgagccttcgagtccggactcagatgacatgttaacaatgacacccttatgttgcttaacgagttccttgaccacgatggaagagcaaagccaaacgcttttaacattgatggtaaacattttgtcgaagttggcttcattgatcacatatttgccatcaggatcagttggatctgttaaaatacgagggatgttgatgccggcattattgaccaaaccgttaatggtgccaaacttttctttagcagtcgccaccatgtgctcaacttgatctcgtttggtaacatcggtctgtacaaacaagagattgtcatctttgaatgagccttccttgagatcagcgttgacaacttttgcatggttaccaatcagatctttaacgatggcgtcaccgattcctgaagagccgcctgtcacaataaatacccgatcatcaatgtttaaccaatctttagccataagttgattcctcctaaaatttaatttgttatttagtgaagcaataacctgagtttatttcgtcttgttatccgtgacatataagcgttgccgcttgtatgcaatatacgtataagcaaatgcactgataaacaagatagcgataacgataaagccgatgccaacctggccggtaaagcccttagttaagaggtacgtgattggtgagcctgcttggtcaagtgaagaaacttctttacccttagcaagtaaattcgtcgcatggccaagggcaacctctagcggatacatttggtttgaaatccagatagtgatgaacataatgaccgaaccagagatgagtgttcggaagatgtttcctttatgaacccctgttgcaatggcgataaagaacccgatcgtggctaaatcaccgaaaggcaacactttgttaccaggtacaaggatcgcaatcagcaaggtgatgggaacaaacagcagacctgcagcaataacgtctgaattaccaagtaacaaagccggatccatccctatcgtgaacaagccacctttaaagtgtttgtccatgatgactttggcaccttgtgaaattggaatgagtccctccataatgaatttaacgaccacaggcattaacaccataactgcggccatttgtattcccaactgcagcgatttaccgattggaaactttgccagcaagccgataatgatccctaatatagcgccaataatggatggctgacctaagacaccgaacttttcttcgacggttttggatgtgattgtaattttgttcagtcccggaatcgcttcaatcagatcatcaattggcttggcgaaaatacccatataagcagatgtcccgtgtggaattgagatgccttccaagccaaaaaagttatctgtaacaggtttgaaaatatcgccaagtttgtaagcgattgctgcatgaacgcaaatggcaacaattccccaagtaaaactacccgtagcaagttgaacaattgcaccagtaaacgccatgtgccaaatgttccagatatccacattgacaacttttgtcatacgcgtaagcaacataatgacattaacggcaatggcaattggaatggcgataagacccatggctgatgcccatgccataggagaagttcctggccatccgacatcgacaacgctaagtcctaaattaaaattcttggccattgcctcggcagccttacccagattatcagttaacaacgagatgactaagttaataccaacaaatccgataccgattgaaatacctgcgcgaagggatcttccaacgccttgtcgcagaaaaataccaagtataaagatgatgattggaatcatgacacttggtcccaaatcaacgatgtattggataacttgcatgctgctacctccttttatatagaaagacaacccaaaaaattgcgataaagatgaatgctagataaaacggtgaagcatatacaagactaacaacgagtttgatgattaatgaaagcccttacacgaatgatgataaacgctttttttaaaattgcaagtcttttgtttaaattattttggtatatacccaagaaaaagcgcttaaatagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaaataaacatatgcaaagaaaatataatattagggaaagcgcttgcattaatttgaattagcgactatgatgactcttgaaaacaactgatggatggagagtgattagaatgacattgttaaacaagcacttgattcatcgcaatgtgacttttagggatgccgatgacgccctgaagtcaatggcgaccgcgatggttgagaatcaatatgtgaaaccgacattcgttgatgctgttatacgccgtgaacataaatttccgactggcttgccaactggaggtattatggttgcaattccgcatgccgattggaccaatgttaatcgcgggacaatttcggttgcaacgttggagaaaccagttctttttaagaacatgggcaatcctgaagaagatttagcagttcgattaatttttatgttggccgtcagtgaaccacatgcagaggttaacttgctgagagacttgatgggaattgtgcaaaatcaagcaacactacaaggactgttagatgcgcccacagatcttgatctgtttaagcgcttagaggatatgtttcaagatattgttgtggataaagagaaaaaagaggagacctcaaaatgaaaaagattatcgttgcgtgtggctcaggaattgcaacttcaactgttgcgcggaatgcgcttgaggaaaaactcaaagctaaaggaattgatatgacacaagtatcgatggaccaaacttcaattccgcaactacgctctaaggccgatcaatttgatttggcggtgacgaccggtaagtttacagaagatatcggcgttccggttttaaacgggctgccatttcttactggcgttggcgaagacgaattagttcaaaaagtcattgatgtgcttggattggagtcgcgaaagtagccaattgatccggaaatgacggttcgcaaatcggagttaatagcttgaattgccgcataaacatggtatgatcaaaatgactcgttttattaaatgggtatgaattaacgtatggtcaatatacgtttagtggcctgatgagtttaaaaaataaaaaagagggatagccctctttttttattgaaaatattaactcgtgatcgtttacttagagtgggaggtgtttatggttgaaacattttagtgtaacgctcacgtctgctgaagccacacatatcagccgtgacaacttttatgagccgctcgacttgacgatcagaaaacaactattatttaactacgctttaaagaatcggcgttggattaaagtaaacggttttttgcgtcggccaggtgattggattaacgaaaaagaagcatttgaggtcactagtctggcatcccgattaccacttgaacagcttcggcgccgatatccggattattatccggtaattaataaatctcaatggcttcgacaacgagatgaggcccaagcgctttttgatacatttattccaaaagtacagcgtcgaaaacgcgcacgttatgataacgaagtagcggcattttgtcatgacaatggttttcaagagattgattcgttacggacgcgtgaagctagaagtccaggcgcgtatgtcgtcgcactggacgattatttgtcgatttatttcggcatcgtacccaacattgctgcttcaatcctagctcactgggatgcattacttgatttgaacgcgataacgacgcttgatgctttgccaattgatgcatttaagccgcttgatacaacccgtatttttattaaaaccgccgaaaagcgtcatcttgaagagctcaaacttgaattagctgatctggttccttatcgatatacgcttaatcaatcttctccctcgttggcaggcatgggatcaacgaaggagacaaacttagcgctctttccaaaaggcgtcgaggtccatgatgcgatgggcgggtatgaattatttgaatacgatctggctcgagagttaaacattcatccgcataaagatgatgagcagtgaccggccagcaaaatccccccacaattaatggcgttattgtggggggatttgtgttgagagaagcaaaaattgaaggggtaaatttattaacaggccgcttgtcacaattttatacagaaagaaataaacttgtgagggaacatgcgattgtcctgttttagcatctcacaattatttactttgcatcctagagggccagtagatgactgagacgagatcggtacaattcatgttataacatagagtaggacatggattgattaagacacgtcaagttaacgctaagatacctttgtgtaaccatgacctttacaatattaaaactaaaaatggtttctgctaactgacagatgagaatggaggtccctcattgaattattttgtgaatgaaaacatattttcaatgaactcaggtacggaattttccgcggcacaacgggtaatgctgttcaaaaagaataaagtgccggcgcagatagtcacgcgtaattacaatccattgatgattgatgatgttcaccgaattgggttagagcaaaaagatgttgtcaatatgtatgactattttcaggagatacttgatgtcgcgcctaaagatgttaatgttcgctatactgaagctattgataagtatcaatatcacattgatggcgtggatccaaatgaatctaaaattgtttatcatggtaaaacgatcggtaaagtcaacattgcgccaggtacagtcgggcttgtggggtcgattgaatactacaatgatatgaatacggttgtcgctaaagacatttgggatcgccgcgggtttaaatcgtcaacccagtattttcatcctgatggtgcgtttggcccacaggttttttacgatcgtgatggtaagcccaagattgaaattacgcggatgaatgtgaatggcgaattgcgcaacaccatgtacaagctgcttgactatcaaggccgggcatggcgctttgataccgaaaatgaaatgtttgttttcttcatgaatgaactgatgcttaaacattctggcgtcttaattaatgatcggccttcattgattagtgaagttgccgcagttgttggcgcacgtggtaagtggcagtttcttcacagtgcccatacttacaagccagaacaagcaggtggatcgcgtaactatgtcgactatctccaaccactatttgccacgcacatgaatgactttgatggcgtcatggtcccaactgtggagcaaaagcaagaaatcgataagttcttccactttaagcatgtcgtggtggtgccggattcatatgctgaaccgcataaactggtccctgctgaaaaacgtgatcgcaataagattgtttatttgggccgaatttcaccggaaaaagaaccacaagaagccgttaagatttttgcaaaagcgaaaaaagacttaccagacttacatcttgagttttacggttactcatctgatcagtcgcttgataattcactaaaagaactgattaaaaaactggaaattgaagacgccgttcactttaatggctaccaaaacaatgaccagttggcaaaaaagcttggagacgccgcggcagtattaagtacctcttcttcagaagcgttcggcatgaatgtgttgcaggcgatgagttttggcgtgccggtgatcggctatcaagttaaatatggcatgaagttggtggttaaagaaggcatcagcggatacttagtgccaaatggtgaaagccaacaaggtgccaaggcgttggttaagttgttgaccgacaaagataagtgggccgatatgcttgaatcaacctatgaatcatcgcagaagtttaacgctgcggcagcttggcaacagtggcaggctcaacaagcagctgttcctaacgtattctcaaagtaggggagagcttagcatatgatattctttattaattcaaattttaataaaaataattccgggattgaacacgctcaattgaagcgggcaggactctttcgtgatcatcatgtgcctttcaagatgatttttcgcgaatggaatcctcgcttacatgaatacttaaaccataatggggtcagtgatgacgaggctttgaacatgtttgactactaccagaatgccgaacaggttccagctaaaattcttcacgctgaagacattgattttggattcgacaagcttagttacgccaaagagccagataaccaccgctatttggtgacccgaggcaaactttttgtcggccggatcaattactttgaggatgactcggctgaacgcgtcagctcagttgaacaattcgatggttttggaaatttgtatcgggttgacttttatgacttccgcggctttttgtcgctgtcgcagtggtatacgccggataataaggtggggactgaggtttggcataaagttgatgggcggccagttattgagacttttaataaatatgacgccaatcatgcgttcattaagaccggatggcggttgattgaagacaacggtgcggtttatatgttttcgaatatagatgatttgacgcagcatttttacaataatgtgaatgagcaatactggaatgacaaagaagtcaatgtctttattcttgatcggtcacatttgggcgattggcaactcattcacttgcagcggcctgcttatattgtcatgaatttacacaactcacatgcaggcgatgcccaagatccgatgcactcggtcatgaataatttttatgagtacagcttgattcatgctaatgattacgatgcgattgtttcagctaccaataagcaaactcatgatgtgcgcgagcgattccacccaacgtgcaagttgtttaccattccagttggcgttttgccagatgaacagttggctcgaccgcatgttgccatgaccgatcgccagccggcaaaagttctggttacggcgcgggttgcccctgaaaaacaaattgatcacattgttgcagcgattgggattgctaagaaagatgtccctaacatttctttggacgtctatggttatgtcgaccaccgggatgataaccgggcgatgaagcggatcaacgcagcaattgaaaagtatcatttacaaggtgcgatcaagttgcacgattacaccaatgatgtcggagccgttcaacggaatgctcaggtttatgcacttgcatccgtgatggaaggctttaatctgtctttgatggaagcactcagcaacggcatggttggggtcacctatgatgtcaactatggcccgaatgaattagttgttgatggcaaaaatggttttgttgtgccatttggcgatattaaggcgatggccgctaagtttgttgaactattcacccatccggatgaattacagcaaatgtcagaccaagcctatgagttgtcggatcgctattcggaagcgaatgtttggaaggcgtggcaagcgttattagatgatgctaaaaagaaggatattcattacactgaagagatatccgctggtattggcgatcaacgggtaaagaaagcgtaaagctccggttttagatttaaaggaactgctaaagtgctcgttattttagaacgaaacaagtgatcgttattttagaacgaaacactttttaaattcttctcaaaacagtacaattagataaatcaaccttaaatgaaggcgggcgcctgaatgaatgacaaattaaagattattgaattacttaagcaacaagtagcagcgaaaacagctgaactgacgcctaagaatattcagaaaataacgcaagacattcaagatttactgaaacttttaaatgacgttgtagccattgattttgttgacactacttctgaaacgagtccgcaacaagagaatacagcagttgcaaaacctgaatctaatgcggcagttgcgccgatgattacccaaacagcgcctgaaactaaaagtgaaccaaagcagcagacgcaaccgcagcaaccccaacagccaaaaccgtcgcagccaaaatccaatcctgaaccggaaacaccattattatcagagcactggttaaataatcataagtcgtacattggtcgcttccatttagatttgaacggcggccatgtcggcaccattaaagtgtcggaaagtaagttacataaaatgaagaacccaccggaaaatggggactgggtgcgtgccgatgagtatcaggatagcgatagtgttaattacaagattacaacgttgaagcgcgatccgttgccaaccgaaattgtacggttgaagtttttgcctgctgtttttcgtgaagatgtgaagcggtggtatattgagtttcaatcaccggaacacgagacgcggcagcagttgcttttaggcgattatgatgtgatgttgtttaagttgaagccgggagattatattgactacgcttatcggcgcggtcaggaaatcaatggtaagatcatttggcgttacactgattccgcggcggttgcgacccgaatgaaacaacgctatgcaaagtcggcgaatacagacgctgataaaaacactgcaactagtaagcagaaagcaacacaaacagcgaacaagacggtcaagcctgcaaagaggcggcgagctgtccagcaagtctttgccgataaaaccttgctgctggtttgttttgaaaactccgccatgccgcgtaaagtcaagcgccatgttgaagaacgcggtggcaaactcgtgttatcatcacactcggattccggcgcgatgttgaagaaaaaagttcaaaaatctgatgtggtgattgtgacgaccgattttgttggccatagtcaaatgtttgcggctaaggatgaggcgaagcggatcgggaagccgatttggatggcgagaaataccaatgagcgtaatttgctgcagtggtacaaacgacattttcctaatgaaagtaagccatctgcggcgcgccaggaagtctaatgaatgagctagaatcaatcattgtgtcacttaatactaaaattttatattaaaaaaaccggtcctgagtgttttgcagtgtgtgctgactgctcagggccggttttttaaatgtgaacttctaaatacaacgggatattcaggcttcttgtccaattcgtggccaagttgcataagttgcgaccatgcgatccaaggcttctttgagtaacgggcgcggcatgccgatgttgagacgcacgaagccgccaccatcagccacaaaatagctgccgaccacacaggacaaatcagcagcagtaaagaaacgtttcatcgccgtttcatcagggaaaagccgctgggtgtccagccaggctagaaaaccggaatcggaaggcatcacctgaatttccggtatgacttgcaaacggttgaccaagtaggcaaagttagcggcgacataagccaccatttcatccagccacgcatcacaatccgtataagcagcgatgagggctggcacggcaaagctattaggtgaggtaatcgaattggcgacgaattgagcgttgagtcgggcgcggatcgctgggtcagggatgacgacataggacgttttcagaccgcctaaattgaaagctttattgggtgataaacaaagaatactttgggattgaatagctgggcaggcttgccagatgctggtaaatgtgacgccgggataaacaatgtcccggtgaatttcgtcactaatgagtaaaacctgatgctggcggcaaagttcacccacgcgtgctagttcttcagctgtccagacgcggccggacggattttgcggactgcagagaatgaacatcttaacgtccggccgttgcattttagcggccatgtctgcaaagtcgaattcgtagcgattgtccacaagcatgagcggactggtggcgagctgacggtggttattgcgcacggcttcagcaaacggatcataggccggcgtgttgattaacaccgcttcattttgttcggtgaatgcctgaaccaagtagtggagggtcggcacggtgccatagctgagtttgatccagtctttttccagttgcaacccgaagcggcgcgcgttccaggcgatgactgtctcataaaaggcttcggggatgtaagtgtaactgtagtcaggtacggccgcgcgtgtcataatggcttggtgaatcggcggggcaaccgggaagtcaaaatcggccaagtccatgggaatcgcattggccgtgagcccgaatttttccgcgagcacttgatccgcccacttccgcgcattgccggctttgcgatcaaaaaggcgattaaattggctcatgttcaagcacctccaattgattcatctgccgagatgtttggtttaacacgcgcgcgccggtttcggtgatgacaacatcatcttcaatgcggacgccgccaatgccgggaagataggcgcccggttcgattgtgacaatcatacccggcgctaaaacggtttgactgcgggggttgagaattggctgatcgccgcctagtcccaagccgtgccctaaaccatgcgtgaaacagtcaccatagccagcagcggtcaaaacgccacggacaatggcatcgacttcacgaccttgcatgccaggcttcaaagcagcaattgccgtttgttgggcgtccagaaccgccgcatggactgcggcaagttctgcgggtggcttgccgatgctgagtgtccgcgtcatatcggactgataatcagctaaaacaatcccaaaatcaatggtgatgagttcgttttcctgcagtattcgctcgctgggtcggccatgcggaaacgcaccccgcgggccactggcgataatcggatcaaacgccatccctgttgctcctgcttgcagtgtataaaaatataaccacgcattaagcgtttgttcgctgatgccggggcgaatatgcgggaggagttgggtaaaaattttgtcagtcatcgcacaggccgccgcaactgccgcaatttccgcttcgtccttgcgcatgcgttgttccatgatcaagtcatccgccaaactgagcgtccagttctgggcagctaaggtctgaaattctttaatcgaaaagccgttgctcaccaagccgatgcgccgactttgctgggaagttaagaagtcaatcaattgcggtaagtaagatccctgaggcacttcgatatttgtaaatccctgggtatctgcggcctctgcacgatagcggccatcgtggatttgcacggcctgcgttggggtcaccacgacatacacaccgctgccgggcaacgcgccgacatagcgtttactttggcgatcatgcagcagcaacgcgtccaaatgttgcgcgccgatcgctttttgtaagttggttaaatgattcatatgagcctccgttttaagtgcattgtttttcgaaaaagggatgcccgcgcaaacggtgcggcatcccattgtgagcattttttcagtaaccacagcatgcggcctgattagaagtcgagatccaagccagccaaggtatcctcgtcttcttttgaaaagattgatttctgcgatgctttcttggcttcattcttcaactcggcacgttccataaccttgaagaatggccagtacaaagcgactgctaggaacagctgcaaggcgttggctaggattgtccggtaatcgccattgattaagaaaccttccagaaagaccccaacgtacggcgggttgaaaatgggtttagcgatccaaccccagtgcatgaagaacattggcagggtgccgataatggcgccaccaaagacgtgcgggatgaacataatcggattcagaataatcggtgccccgaacagaatcggctcattgatgccaaacaaggcggggaataaggaaattttaccgattttacgataccgcttgctcttagacagcatgcaggcgaccacacagccgatggaaatgccgcaaccggtaaaaccaaagaaacttgaaacggcgccggctgtgtaaaaatgcggaattgcttcgccggcgttcattgcagcaatattttcggcgatgaacgtcaccataatcggactggtgatcggcgagaaaaccgacgagtgaattccaaagaagaagacagtacaaatggcgaagttaagcgccaagacagcccacggattatccatactcccaaccaatggcgccaagaagcgagtcaagatgcttggcggcagctcaccagccagattcaagaagataaagcggccggcaataaacgcaccgccagtaatgagtgtgaccggaatcagctcgaacgaacgggaaacaaaatccggcaccccatccggcatcttgatcgttaagtggtgagttttgcaccagtgatataactcaaccgtcagcaaggcaacaatcatgccggtaaataaaccgcgagcgccaaggttggcgacatccagttggccggttttgttaaaagttgcgaccatcatcaaaaaggcaaaacccgacaaggtgacacatccgggaatataaagcttgtaatgattacctaagttgtaagcaatggataagcaggcatacaagccgatcatcccgatggacagcttaacaggcaggtcgaacagcgcggcgttgccagtaatgaactgcgaaacggcatttttagggccgagcatattcggcagtgcggggatgatcgtgaaaatactgccgagaatcgtgaacggcgtcatagccaccatcccagccttaatggcactcagatgacgctgattatccactttatgggcgatgggcatgaagaagcggttcataaaagcttcgaacttgttaaacatcgtggtgcgctcctctcaaaattttgatcagccactaaccggcatgcttcttttgatattttgcgtgagtcaccagcgccagtttcatcaccgtggcaccatccatttgcccgtaaacatctttatcgatgacggcatacggaatatggcgcggatcacagatttccccaatatagccagtcttatgcccaatctggggaccgaccaaaacaatgtcatagttgtcgatttcttcttccagtccatcaaccggaatagcattaaaatgaaaatccgcttcgttcagtttgcgactgtctttaacaaccttcgccatattttgcatcaacatattggtggaaaagccacctgcacagcataaaagaattcgcatgattttgttctccttgtatatttattaatgtgagcgcgagccggcgcggttagaagcctgcttcattcacgctctagtttcaaatacctcaatcaacgtttcgatcaaatctcgtgccagttggctggtcatgtagtgatcttgcgcgtggaccatgagcagacttacgggttcgggcgtctggtccggtgcaaactcgcgcgcgatcatggccgtttgtgcgttgtgggcggcgacatcaatggcttttgactcggccagtaagttgcgggcccggtcaaagtcttgcgttttaacggcagccaatgcttcaaaggctttggttttgctttcgccggcgtttgcgatgagctgcataatttcgagttcttgagtagttgccatagggggtggactccttcttacaaacctgcagtgggtgggtgcagatgttttttaatcgttgggcgggcgctagtggtgaaacttttaaaaggtatgtgccgcggccacgagttttgctgataattggcggcacatcgcagcgtataaagcaaccatctgatcaacatcgcgggtgtgggcaagcgattgagcgcaatggccgtaacggcaagggaggattgtgaccaccgttggaatgccggatccgactttgtgtgcctcaccaccatcggtaccgccgccattaaacatatctaattgcaaagggatttctgctgcgactgcggttgctttaacaaactgttgcagatggcgatttggagctaaggtgcgatcaaagtgggtgagaatcggtcctttacctacttggcgctggttaacttcgccacgttcccgtggattttgaaaagttgccacatcgacaataaaagcaagatccggtttgatcagctgagtggcagttttggccccacgaatgccgacttcttcactgctagttgcggcaaaatgcaaggtgaacggcaatttttcatctgccagttctgcgagtagttgcgcgccgacgtagcagccgaggcgatcatctaaagctttgccgccaaagacgccatctggggcatacccatgaaactcggtcgcaaacgtcaccatatcaccgattgcgattcccaaggcagcgacgtcatcagcattgtttgcgccgacatcgcataaaacctgatcaaatgccggcaatgtgtcatcgcgaatgaccatgcccggaagcttgtgacccgcggcggttgtgatgcgtacgttctgccagtgactggcggcaggtttaacgccgccgacaaccatcagacgcagcagtccttcaggggtaatggtacgaaccatgtaccccacctcgtccatgtggccataaataatgactgaaaactgcggatcggcggcttctttggtgaaaataaggctgcctagcccgtcagtttggctggtcaatccatatggggcaaggtgatggcgcaaaaccgcgcgcacttcgctttcgttggctgcaatggcatcagcgttacttaacgccgccatcagttgtaaatccatgtcgtttcggctccttccagttcagtccgtaaagtttgttgaaatgcgctaaattcggtttggtgaactaattgattgatgagatcaggcttttgcattaacgcggccaattgggtggtcaaagttcggtgtaagggtaattgatcctgtttcaacgcaatcaaccacacaatgcgaaccgggcgcgcgctatttttgacgccagttggcaaaagcatcacggcgaccgcatttttcctggcgctgaatgacaaggggtgcggaatggcgatcccgttgtcgtaaaccgtcgccagaaagtcttcgcgctgcagaaccgaggctgcgtaaccaacttgtccgcaataagccgccattttagcagtgagggtggtgagtaacgtccgatagtcggcaggcttttgatcggggaaaaatagcgttgactgcaacaaatccgcaagggacgctgtggcatgatgttgcgatgccattgatagctcgtgtcgtaaactggcaaagtccaaatctgaagccacttcatcaatctgaatcacgggacaatcaaatgattcatttaaagccgtgacggtaaaaagcaagtccggtgaaagttggtggattgcttttaactcattgaggccaaaagtttgaatcaccgcctcaggaaaaatccgtcgcaggcgtaaactcagcagcgttgcaatgccgccaccagttccgcagatcacggcaatgcgataaccatgccggctccatttttcgtgagcctgttcaagtgggaccagcagatgggttgtcagatagccaacctcggtttttggtacctcgatttggtattcgcggcttaaccattgagcaaattgcactgcccagttaaaggcgatcgggtaatcgcgcgccaaaggttctagactcagaccggccagactttggtgttcttttagtcggccaattaaggcgaggacgtggaagtacatgagcgacaggaattccggatgcgtagcaaagttggtttcatggcgtgcatccagcgttgtgaaataagcgcgaagtttgttttttagccgctcatggtccagacgcgtggtcagttgtttgcgtttggcggcaaaactgacggttaaaaaatgccacgcctccggacttaggcgaatagcggctaaaatcgctgcaaagtcagtgtcagcaggcggggcgtgtaacgattggcccgtgacgacaagcgaccacccaatttcgctggcaaactgggtcgtgacagccggatcgagtcctaaaggctgcagttgctgagccagtgtcgcatgattgggcggtaacccatattgttgcagcgcatggatgcgactttgccagttgccttgaattcgcacgccgtaatgggctttgcggattaacgacaggggcgttccaaccagcagtttgtccaactcgcgtaaatcacgctgtaactgcttggtactaataagctgggtggcggccagttgcgccaccgtcaaatagtttgtggtcgataacagctgttgcagaagctcgggtaagcgtttggctggcatttttggctgagcctgacccgctaaagtcgcaagatacgcagctaaaagtttcgtatctgtaatctgtaattcataccctcgtccccgaataaatcggatttgaaaccctgacgcatcgtggtttagcaggcgcaaatcattttgcaacgtacgccgtgataccccaaccgctttggccaaggccatcgcggacataaccccgttagcttgtagtgcttgaatgatgagttgttcacgcaattgccttcccccaatccgtaagcgctttcaaccatattgtcagtatgccgcagaaacttcctgtcaaaaagtcccacttttgcaagctgacatggcaaaaatggcatgattgccaatgcgcctgccactggtcgtgaatgacgaatgatatagtgaccgtgcttattccctgcagtgtaccaatgtttgaggtggataacgatttgagctggtcgagaaaatagtgagacggcttggttagataatgagaggcatgacaaagggttggggcagtttacgataaaggggaaataaatgaaaaagttgcacgcaaaaagccccatgctgtttgcatgaggccgagtggatagagagctagcattaccggcatgcagcagacgcacgccaccaaaatgaatccttaactacgcaatatcgccatctgcgtttaactgcgccatatgaatcaaggtctcggcaattttacccattgcttctgttgagacgacttcatacgggccgtggaagttaatgccaccgttaaataagttaggagtagggataccttgataagtaatctttgagccatcggtgccgccgcggaatggaacggttttaggcgtcagaccagctgctttgatgccagcttcagccaagcggagcgggtaaggatctttattaataatatcggccatattgtaatattggtcgtgcatttcgactttaagccgcgggtggtcaaattgagcgtttagttcatcaatcgtcttttggaagtaagctttgcgggcttcgaattgttgatgatcaaagtcgcgaataatgtagaccaactctgcatcactgatttcgccgtggaatttcagaagtaaaaagtagccttcatgtccggcgctgaattccggccgatcaaatgccggtaatgcggcatcgagctgacggcctaaggtgttggcattgaccatcaatcccttggcctcgccgggatgaaccgaagtcccttcaatggtgacggtggcttgagcagcgttaaaagtctcgtattcaatttgcccgggatcaccattatccaaggtatacgcaaagtcggttgcaaagcctttcgcatcaaacttatcggccccaactccgatttcttcatccggaccgaagccaaatttaatcaggccgtgtttgacttccgggtgagccaacaaataacgagcggccgcaactgccccggcaatcccggccttatcatcaacacccagtaacgtcgtgccgtcgctggtgattaaggtctgaccaaaatattgcttcaacgcggggaactgttcaactgtgagactcaagccattggcaaagttgatcggtttgccatcgtaatgcggatggacttgtggctgcacattctcggcgttgtaatcagccgtatccaaatgcgcgatgatgccgaagcttttgaccggcttatcagtgttggccggcaaggtggcggtgacaaagccattttccgggtttaagccaacgtcttggagtccgagttcttgcagctgggttactaataacttggccagttcggtttggccaggcgttgatggggtggtggcgcgtcccggataagaccgggtgttgattttggcatagcgaatgaaatctgtttggatttggttcaaatcaagttcaattgtcaatgagaatccctgcctttttgatgagaaaaatattaatattccattgcaattagtgtgagactggcttagtattttgtcaatagcacaataagggaattattggagggcgcatatgaaaatatccaaaaaatggacgctagtgttgccggttgctgctgtactgcttctggccgccggatgttcgtcaagtagcagtagcagcagtggcaagtcgagcactaaccagacgcttaactggtcggaaacctcgtcaatcgtcactaacgatccatcgcaatcaactgacacggtatcgtttcagacgatgaccaacacgcaggaagggatttatcggttaacggataaaggccaaaagccgcagttggccttggcgaagaaagtgacgaccagtcaagatgggctgacctatcatgtcacattgcgcaatgctaagtggagcaatggcgatccgattacggcgcaggattttgtctatagttggcagcgcacggttgatcctaagaccaaagccaccgatgccttttattttgctccggttaaaaatgccaatgcaatcattaagggtacgaaaccggccagcgatctgggcattaaagccacggataaacatcacctaaccatcacgttggaaaatccgactgcttacttcaagaagttgctagccttcccactgtattatccgcaaaatcaaaaagtggtggaaaaatacggcaagaaatttggaacttcggcaaccacccaggtttatagtgggccgtttaagctgaccaaatggaacgggacgggtgatagctggacgttggttaagaacccgcagtattgggataaaaaacatgtgaagctggccaagatcaatgaaaccgtcattaaagatgttcaaaccggcatgaatctatatcaaacgaagaaactggattcgatcgtgctgactggcgaacaggcagccgcacatctgaatgacaaagacgcggttaagcgcatttcctccaatatgacccgcgtggacttgaatcaaaaacaagtaccagccttcaaaaatgttaaagtgcgccaagccttttctctgatgattaatcgtgccgcactgacaaagaaggttctgaaagatggctccaagccagccttgggttttgttccaattggactgcatacgaaccagaaaaccggtgccgactttgccaaaaccacgcaggtgaaaagtgcggttgcttacgacaaggacaaagccaagaaattgtttgaagcagggatgaaagaagccggtcaaagccagctcaacttgaccctgttagcagatgatgcagatgtttccaagcaggtagccgaatacttgcaaggcgcgtttgaagatttgccaaatgtcaaagtgacgattaagagcatccccaaggcccaacgcctgcaagcaatgatgtcaagcaactacgatatggtcgtcaccggctggcaatccatctttgcggacgcgtacaacttcttggatgtgtggatcagcaattccagctacaacacatccggttacaaagatgacaaactggatcagctgttgagtgaaacggaaaccaagtacggcaatgaaccccagaaacgctggaccatgttgcaggatgccgaaaagatcttgatgaaagaccaaggtacgctgccgttgtatcaagccaataacttgcagctattgcggtcaagtgtcaaaggtgtatcgtttaatcctaacgggacaccatatgactttaaaactgcatacatccaataatattgggataacaaaaaagcccgccatgctagtgacacggagattaaccgtgaagcatgacgggctttttgcattcattgacaaaattatttcaagatggagtgactcaaaatataaaaagcttcctgactagcttgatgatgcttgggcttttccgggaacccctcatcgaatttgcgtgcgtccgcggggtcataagtcatggcgggactttcatggtagaaccacttctgcccggctagcgtttgcggctgcaactctttgactaacatcgcggttggttgggtattgtccgccgcccaaacgttgaatttttgacagctttgaaagccgcgggcgacgtaattgtcaggatcgccaaaaatgacaatcgcgccatagccaaggttggctgcttgctgcatggatgcttcgattagttgctttccgaacccacgtcgctgataagctggcgtgatactgaccggtccgaatgtcacaataggcttctccaaaccggttgcagtcaccaatttactcttggtatacatgatgttgccaataatctgtccgtccagcgttatgacaagatccagttcaggaatgaagtcagcgtgatcgcgtaaaatatgggctagataatgttcatcggccccaggcacataaagattccagaaagcattgcgatgaatggtttcaactgtccggtaatcggatggctgttcagtacgaatggtgatgtttgtggtcaagattaagtctcctaagaaaagttgtaattcgggactacttttatttggaataaaaatttttagagaaaaatttaatcagaaaaaagtaattataaaagtgtgggaaaagctcgggaatgaggcacttacataaagtgcgaaataaaaatcgaaactgccgttatcttacgcagcttcggcaagataacggccaatctgataagctgaggccagcagataaggataatgagcggtggtacctgattcagaaagtaggtggtgtgtatgggcaaattgtcgataacccacacattgatgagaaaggtgcacctgtttgtcagtgatcgatgttgtaacagcgatcacggcctgcgtttgttcgttggtagtcttagtcattggggtaactcagttgatcaaggcgacgaccaagctgcttcatgcagtaaacgaactcatgcaggcgctcgaattatttcgagaaaaataggcaaactaaaagccgcaattccttcgctgggatgccgcggcttttagttgcctaatcctagttaccatcgttcattagatgggtctgcaagggcgaatgcccagccgtcgtgctcgaacgcgacggctttttgcttgctttaagtatagcatggcagctcagaatatttctagtcagacgacaaaaaatatgttgagtgattggttgaggcaatatgcgaactcatacaggcgctcgaattatttcgagaaaaataggcaaactaaaagccgcaagtccttccccgggattcggcggcttttagttgcttaattccaagtgccatcgttcattagatgggtctggaagggcgaatgcccggccgtcgtgcgcaaacgcgacggctttttgcttgccgtaagtatagcatggcagctcagaatatttctagtcagacagttgtaaaatttcaaaagatgatttctaagtgaacgtccgatacatttgatagatgaaagataactcatgtttcattcaaattcgtttcctgacatggcaattattcagtttcagactgcgaaagccctttaacgtagccttctgcctgcattcggtacatttcggcataggctgcattcgtttgcatcagcacttgatggggcgcaaagccaacaaccttgccggccttaaggaataacactttgtctgccatcgttacggaagaaagtcgatgggtgacaaaaagaacggttttattttgacttagctcggcaaaatgttgataaatttcaaactcactgcgcggatcaattgcagcggttggttcatccagaatcgctaggtgggcatggtcgtcatttaagaaagcccgggctatggcaattttttgccactggccaccagagatttcaatgccatcttcatattgcttgccaaaatgcgtttgcaagtcaatctgctggtttgaaaagttatcccatgcgctggcttttttcagtgccaattcaacattctgcgcgttaaagtttggcagatcggcaatgcccacgctttccagcagtgacaagttgaacttggaataatcttgaaagacaacgcgaatttggtggcgataagcatcgacgtttaattgctctatcggcgtaccgttaattaaaatctgacccgaagaaacatcgtataggcgtaataagagcttaaccagcgtggacttaccagagccgttttcgcccacaaccgccacagttgtaccgggatcaagcttaaaattgacgtgttgcaaaacggttttgtgattcgtttcggggtaagcaaaagaaacatcgcgaaattcaattgcaaatggtttgtctggcaaagctgcggcattttggggtgtggttaagacgtctttcttgttcaaaaattgataatacttctgcataaataacaacgtatcatacaacaggcttgagctttcgactaaacttcccagactttgggacaacgaaacgacggtcactgcaaatgtgagtaaggaagccacgggatagttgccactttgaatgccaacgatgactaaatacagtgaagcaaccagcgccaccccgttgatgaaggcatagacgcctgaaatacgcatttgcttcaaacggacttgactgaggcgacggtgaatttgctggaatgtatgctgatacttcttgataaaaaaatcaaaggcattaaaaatccgaacttccttggcatccgtattcgccagtaacgttttggcgtagtattgcattttacgggattgcgggcttcggtccaccatcgtttcaaaggcgtcttgttggatcttataggtgaaaattgcttgcggaataatcggtaataaaaccaataagatcacaacaaaattaaactgtgacaataagacgatgtatgacacgattgataaggttccccgcagaagatcaaggccgaaaacgatcaggttaaccggccgccagctggcttgggaccgaataaactccagctcgtcataataggtcgctgtttcaaatgttgcgatgcctttgagctttttggcgtgtgccatcaaggctaaattgatatgcgcgacaagttggtctgtcagtaagccttgcgttaacgtgacaaccggcccggcaatacccaaggcgatcaccgagacactccaaacgacagctggtgcgagcggtgaatcgtggtgacttaatgcagtcaaaagtgcctgagaaccggcaatcgttgctgcaggcagaatggactgaatgggcaccagaataaaaagaatggttgcgtacaaaggtgaggctttaaagaactcgcgcaaactcttccagtataagtttagaaaattggctaaggttttaaccatgctcgcaccttcttatcgttttctaatatttaggacgattatagcatgtgatggcacgcggcatacagttgatttccaagtgctagcggtttcaaataaaacatgctatactgcctttacaatcgaatagaaacatttggggtgctgaaaagctgagataatacccatggaacctgatgcagttagtactgccgcagggaaatgtcgctaagatcaatcgttttatgacgatgcttatttgtgatttcatggaccccgccagtgtttggtgccgggtcctttttctttgagttgacctgttcgctaaccgattggcgggagaagttgatggagattcacacataaacatggttatgactgattgtgactgcttaggcccccgtctgtcttttgttcgaagaaagaggggcttttttgatggatagatggtctttgcgtgacgtggtcttgttggcgtttttagccttcttgtttggcggtgtcttcatgggtgccgatgcaatttatgccgtgttggcggcggctttgacaccactgggctatgcaccttttgctaacgagattctgtttggcatgtgggtgatggctgcaccgatgacgaccatgctgttgcggaagaaagggagttcaattcttggtgagtgtttggctgcgttggccgaaatgctttatggctcttattttggccctgccgttttgctatccggttttgttcagggactaggtagcgaggccggatttattgtgacgcgataccggcgctatgacacggtgagcttgcttttggcggcagtgggcaccaccttgtttagtttcacttatgaatacttcaagctgggttatggcgcgtacagcttcggcatgatcttaggcttggtcacggtacgtttattgtccgtcattttctttggcgtcgttttggtgcagttggtcatgaagctttacgagcaagcagctggtgtcaagcgccttgctggcaggtaaaagtcaatgggaattaggttgaaagatttacagttccaccgggaaacgccgctgtttgatcacctgagttttgagtttgcgacaggtgcgttaacggtcctgacaggtgatagcggcagtggcaaatccacattactcaatttaatcgccgggtttgcgccaatgacctattccggcacgattttacttgataatcatgatctcagcggagccagtatgcaggcaaaagcgcagcaggtcggcatgttgttccaaaatcctgatcaacaatttaccatgcggacgttaagcggcgaactcgcctttgcgttggagaatctcggcttgtctgcagcagccatggcccaaagaagtaagcaggccgtggcactgggcgatacgcaagcgttgttaaatcgtgacttgcagacactttccggtggtgaaaagcagcgggcagcattaaccgttttgctagcaatgaatccgcccattttattgctggatgaaccgtttgccagtattgatccggtcagccgccagcagttgattaccaagttaggccgattgcgcgatgctggtaaaacgattgtgattgcggatcacgatttgcgtgattacgccggagtagccgatgcgctagttgctttgaaagacggccagctgaccaggctgccactcacaactttgaccacgattcccacccggtttgacttaacccaagccaatgcagccaccgtttcgttgctacgatttgaccaagttgtctgcgcccggaatcaccaaattttggtgcaggctccgacatggcagtttaataccggtatcacgactttgacaggcgctaatggtagcggcaagtcaaccttgctgcgggcaatggtgcagttgcatccgtatcgcggccggatgtttctcgacagccgccgattacgccgcactaaaaaactgtaccggacgatgacattggcggtacaggatgccggcaagcagtttgtcacattgactcccgccgatgaacttgcatttgggccagccttgacgccaaaagtacgcaaacgccaggcagctgcccttgcctatttgggactgacaggaaaacaaaccggcagcctgtatcacttgagcgaaggccagaaaaaaatggtgcagctgatcgcaatgttaagcctggagcgaacttttttgctgttagatgaaccgtttagcggcttagatgaacgtgcctgtgcattctttgccgcgtggatcaaggaaaaagcagctaagcaggcgtttttgattgtgacgcaccgactggctccgctagctggcatcagtcaccagcatgtggcacttgccgatcaccggttacacattctacaggagtgacatgatgccagtaaaaaagaccaatgcagtgaatctgagtttatttattctgctgctgacacttgaaatatctttcagccatgcggtgagtcttaatgtagcgttgatcggactggcaagcggttttttaatatggcggcgggcgtttaacagtctcgtcgttttggccttgttaccgttgatcccggctgccagcacgtactgggcaattaccctgcatggtacggatacgacttacgctttgttgctgtgggttcgcacctatgctttcaccgcgttggggttggtgtttcttatcggggttgacttagagaccttgctgttatggctggagcagcataaattatcccctaattttgtttacggattactggttgtgattcacgccttgccgcaaatcatgcatgaagtggctgctattcgtgaagcgagtctgttacgtggccaaaagttgcacgcgtggtcgccgatgatttatgtgaaggtgatttttgtggccatgtcgtggcaggaccagtacgtcaaagccatgtatgcccatggttataccgaaggagcagcgcgaacggttcaccaaaccatccgtagttcatggtgcggcttgatcgccatggtggggggctttgtccttttgaatctaattgcccgttagtttgaggatcaaaaagaggtggtcgcgcggtgtttaagcgattgtgcagggaccgacaccgcccgcgacagattaacgcgtactacaacaaagtcattaaatgaaggagtgcttatgaaattttccaaaattgcccggcaacaagttgtgccgtactgggaaggcagtttttcccatccgtttttgactgaattgcaagccgggacgcttgatccggccattttccgctattatctcattcaagatgcgtattatttaaaacattttagtcggttgtatgcgttaatcgcccagcaggctcaggaatcagacctgaaagcttatgcagcgcaatccgccgcgggactggcagaaggcgagttggcggtgcggcgggacttttttgacacgctgatgatcaccgacgtcgaagtggcagcaactgccattgcgccgaccgcctaccattatgtatcgcatatgtatcgccaattagttgccggaacgccgcacgtggccatcgcggggatgttgccgtgtccgtggttatatcaagaagtcgggcaatatctagcccagcgccaatcaccggtgccaatttatcaacgctggattgaaacatacagcggagcggccaacgcggatgatcagcaggccgcggtggcattggtcgatcgattatacgatcacagcacatcggcagaacagcagcagatgctagccgcttttcgaatcagtactcagatggaatacagcttttgggagatggcctatcacctggaaaagtggccggaagggagtcgcaacaatgacgcaaaatcgcgttaaacggctagcaatattggccatgatgatcgcattggacgtggtgttgtcacctttatttcgaattgaagggatggcgccgatgtcgagtgttgtcaatgttgttgctgccgttgttatggggccgctttatgccacagttatggcctttgcctgtgcgctgctgcggatgacattattgggcatcccgccgcttgctttaaccggcgcggtgtttggcgcactgttggctggaatcggttatcgcattggcaggcggtcggtatgggcagcagctggtgaaatcctcggcaccggtttgattggctcgctgttgtcatacccggtgatggtttggttcaccggcagcagtcagtcgctatactggttcgtctacacaccgcgatttttcggcggcgcgatttccggctcgctgattgccttgtttgtgttatacgaacttgaccatagtggcttaacccgccggctgcaaaagatcttttaaccgctttacccgcacttcaaaaagaataatttataggaggcacataccccatgaatcaatccgtaaccacaagctttaaacaggcgtttgaatccgccttgccactgacttcatcgccgttagttcaatgcattaccaatgaaattacagtcgagtccatggccaatgcgcttttgtacattgatgccaagccggtaatggccgatgccgtgcaggaatttccggaattttttgcccaaaataatgccttactgcttaacttgggacatatctcgccagaacgtgaaaagagtctgctagcggcgggtagttttgcggctgaaacgcataccccggttgtggttgatctggtcggtgtttccgccacccaattgcgatatgaattagggcatcagttgttggcgaatcacccgaatgtggttaaaggcaatatttccgagatgcgccgctttagtggtctgaaaagtaccggccgcggggtggatggcagccagctagatcaaagccctgccgcattttccgaacttgctgaagcgctgaagcagttgacccggcgttttcccgcgaccacttttttggcaaccgggcaaacagacttggtggtcagcgctcatggccagtggcgcctggaaaatggcgtcttgcaactggatcgcttcacgggaaccggtgatattgttggtgctttgattgcagcgctgcttggggtagggctcacaaacgatgcagctgtggtcgttgccgttagctattttaattgttgcggtgaagtggccgcagccgaaaacaccggcggcctcgcgtcatttagagagaggacactggatcaattatccttgttggcaacgcatcaagattggattcaaaaggtgaaaggacaggcactatgaatgcagaagctttacaactttatttagtcaccaaccggtacgccgattcgcctgaagtttttttagccaagattgccgcggcgtgtgaaaatggcgtcacaatggtgcaattacgggaaaaaagcctaacaacccgtgattattacgcgctggcaaaacaggttaaattgatcaccgaccgctatcgaattccgttgatcattgatgaccgggtggatgtttgtctagcagtcgacgcagccggggtgcatattggcgatgatgaattaccggttgcggttacgcggcagttgcttggtcccgacaaaatactgggcgtctcgaccaaaacagttgcgactgccaccgctgcagttacggccggtgctgattatcttggggtgggcgctatttttccaacccaaaccaaggccgctgctccgttgacgtcacttgcaacgctaaaagcaatcacagcggcagtttcagttccgatagtggcgattggtgggattaaggcggataatcttgacacctttaaggcaaccggaattgccggcgtggcgattgtcagcgagatcatgcaggcttcggatacggcacagaaggtccagactctcagcgctaaactgaaagaggtgttataaaatgaggattaacagcacgcctcaagtcgtcaccattgctggatcggattcaggcggtggtgccggtatgcaggcggatctcaaaacctttcaggcacgtcatgtgtttggcatgagtattgtggtggcactcacggcgcaaaacacatacggcgtccaagccagtttgccgattcctgacgatttcattgatgcacaatttcaatcattggcggcagactttgcgatcaaggcatgcaaaaccggcatgttagccgatagtgagcatgtgaacgccgttgtccgtaatcttaaacaggtcaatttcggtccgttgatcgtggaccccgttatggtcgcaaaaggcggggcaacgctgctggcaccggaagccgttgcaacgattaagcaggaactattgccgctagccgatgcggtgacgccgaacttgccggaagcagaaatcattgtggggcatcccattaagcgtgaaaccgatatgacagcggcagcgcaaacgattcaggaactcggcgtcaaaaatgtcatcatcaaaggtggccaccgtcaagatgcccaagcttcagacttcattttgttagcagacggcagcagtttttgggtacggtcgccacgcatcgccactggcaatacgcacggtaccggcgacactttttccgcctgtattgcggccgaattggcaaagggcgagtcactgaagaaggcgattatcacagccaaagcatttcttgaaggcgccattagccaaggcatttttgtgggccatggacacgggccgaccaatcattgggcaacgttaagcgaagacgttcaggtgagcgcggtaaaatcatcgtctagtttgcagggatagcaacctagccagaggcatcgaaagtaagtcactcattatgatggggtggcttattttttagtaaaaatatttttataaaacgctaccaattcccgtgtaacaacgatctgaaacgttggtatagactggcacagcgctgtgaaacactattatttttatgaagcttcatttatacttacggcaaggagatgcgaggttctcgatcggcgttcaaaagcgtggctgactgtctggtttaccgtcattaaatcggtggatgaccggtgattaaaatggcattcggacacgtttaacctgacgatcagaacccacgcaagtcagcttggtgcccgggtaactggaagcttaagcgacccgcactcctagtttgtatttggaggcaataaattgtgcaagaaaatgaactgacaccccagcgttatatgagctggccagttttgagtttacttgtttttattacggttattggttttgaaaacatcttctacccatttcaaaatcaaggcctgtctgttgtgatcaactgggtgattttattaatcgtctacatcgtcccgtacgcgctgattgcggcacagctggggacgacttttacccgggctgatgaaggtggcgggttggcaacctggatgcggcggacgctgggggatacctggggttattggaccagctggatttattgggctcagacgctgccttatctggttgacgtgtccaatgccgttatcgtggcgctttcgtggatgattctcggcgacaatagcttgggtaagcggatgtcgaatctgacatttggcttgctgacgtttgccattattcttttattcatcgtcttggagaatctgttctcgcggtcgcttgaagtaatgtcgcttatcggcggagcagccatgtttttgatggcggtgctgtttgtggcgttgaccgcggcgggattggctaaggggatgccttcagccacgcactttagttgggacgcatttcgaccccatttttcactgcattattttgcgaccaccgggctgctgatttttgccacttccggtgcggagctgggggctacgtatatcgcgcagttgcggaacccgaagaagcaatttcctaaagcgatgtgggcactggcactgatgaccgggtttttggtgattttcggttcgctcgcattaggcgtgtggttcaacgccaaccatctgccggatgacttgaaaatgaacggcgcctactatgccttttccatgctaggtaaggcgtggggctggggtaaaacgctgatgtatctgtttgcggttacgcagctgttgttcatgttggctcagctggcggtattgattgatgcctctagccgtgtgttgtctgccgatacggcgatgcgctttatgccgaagtggttactgcagaagaataagcaagggcggccagtacatagctatattttcaccgcctcactttgcttgttcctgttgttgctgtcgggcacattgccgaacatcaatgcaattttcaactggctgctgaatttaaacggcattgtgtcaccgtataaaacggcgctcgtgttcgtggccttcctggcgttgcgcgctcaagccgacaaatttacgtccggctacacctttatcaagagcaaaaccggtgcctatctagtcggcggctggtgcttcgtctttacctttatctgtgcaacactaggcttcttacctcaggaagttgtgtttggaaccaacggctggacccatcagctcatcatgaatatcatctccgtcatcgtcctcttcggctttggtttcatcatgccgctgttggcacgacgagatgtgatcaaggaaaaattgctgtaagcagcagctgaatcgttatcccgaaaagttttgggataacgatttatttttttgcatcgaagaaagtgtcgggcgcaatatgaccaacaaaaaaagtttcacagatattgaacagaattcacaaactgattgataccactgttatgcaacagaatcatgttttcagcaatacagatacgcacctcaagttaacaaaaagtctggttcacacaagatccgtgagatgacactttgcaggccggtgtatagcagttaattcacctaacaaaccagcctcatgttcatttaagttaaatttgtttcatgaaaaatgatttgatttagttgacagcgcttccatgtgcggggtaagcttggtttgcaagattaagtaaaacgttttacctaactcagcaaatagggtcgtggttggtgtgaagaagaaagtttcgattacggacgtggccaaggaaaccgggctttccgtcaccactgtttcgcaaattttaaatggcaaaggcgcgcggtttagcgaaaagtcacgcaaacgggtgctggccgctaaagaagcattgggctatgagccggatctttttgcccggggcctggtcggcaagcgcggcaactcaatcggggtcgtgattcccgatatgatgaacccattcttcgccagctttgtcgtcagcgtggaaaaagccgccattccgcgcgggctgtttccgcaaatcttttcgattaatgggttccatgaaaatgttgattattttattcgacagtttctgggtggcacccaacgcggtctgattcttgcggcgccggaagcttcacaggaaattgtccaaaaagtcgggaagcagttgaatctgcccatggtgtttacggatcaggcgaccacgctgatgaccggcgacagcattcggattgacgaacggcatgccgggtttctggtggccgatcacctgttgcagttgggccaccgccgcatcgcattcgtgttaccgcaacgattgactgttaacttgaaggatcggatggcaggttatcagcaagcatttgcgcagtatggggtccagctagatccggcgctgattttccccagcgcgtttaatccggaaggcggtcggcaagcggtggcacagatcgtcaagaccaatgccacggcgatcatcgcgatcaatgatgatgtcgccagtggagtctaccgcggcttgtatgagcaacacaagcggataccggctgactacgcggtggtcggattcgatgatgtcagccaggcacgcttcatgacaccaggtttaaccaccctcgcccagccaattgatcagttaggccaacaagctgttgaactcctggttgcgcagatgagtggcgagcataacacacgtaacacgattgaactgccagtgaaattggtgaaacgcggctcaacgaaaatagcaaaccaccgcggctaatcgtcatggcattttcacaaggagggggaagcattgaaaaaagggactgtcatcaacactcaactgtcacaagtgattgccgatatggggcactttgacggcaagacgattaagaagaacatcgaatcgccactgtcattagtcaccaccgaggatgcgaacaagtaagcttcatgctatgctggtcaagcaatgtcgcgcggtaaggtaaacaaaaaaggggccgaatgcggtcccttttaaatggaaaaatggaggggtctttatgcctaatcatgttgtcgtcattggcagtatcaatgtggatgctattttacacattcaacgactgccacagccgggagaaacaattcaaatggatgctttttctaaagctgccggtggtgagggggccaatcaagcggttgcggcggcgcgatctggcgctaagaccagtttcatcgggcgtgtcggggatgatgccaatgctgctttcatgcgtggcgagttggtgaaaaatcaaattgatacccaatatgttgcgaccaccgcagacacggaaaccggacaggcatatattctgctccaagcatcgggccaaaactcgatcatcattcaacatggcgccaactttgaactgacgccagcggatgtgcagcgggcgactggcttgattcaatcggctgactttgtggttgctgaactggaaacgccggtagctgccacagccgaagcattcaaaatcgccaaagctgcggataaagtaactatcttaaaccctgcaccggcgcaaaaagatctgccagaagcgctgttgaaaaatgttgatctaatcgcgcccaacgagactgaaagcgaattgattaccggcattccggttaccgatgaagccagcatgcgccagtccgccgcgtattatcatcaactcggcatccgcggggtggtcatcacgcttggttcgaaagggtctttcatttcgctggatggtcaggcaaccctcgtcccggctttcaaggtcaaagctgtggatactacggcagcaggggatacctttatcggcgctttagtcagcaaccttcagcccgatctcggcaatattgtcgatgcggaaacttacgccagcatggccagctcgtttactgtccagaagctcggcgcattcccgtcgattccgatgggggatgaggtgcgtgcggggttggcgaaggttaaaatggatcctgcgtaaggttaatcgtgtccgaagaagatcagttagactaaaatcgcgtcaacttctcacaaaaaggggaggttgacgcgatttttaagattggcgttagcggcctatcgcttaaactatcgagacctttacttgcttgcctaaagcatttgcgattttggttagcgtttcgatgcttgtattatttccttgttcaatacgcgcaatcgttgtcttaggaacgcctgatttgtttgcaagttcctgttggctcaatcccgcattttgccttgcctctagaacagcgtaggcgcttgccagtttggctttttcagattcggctagcttcctgtagctggagtcttgcatcatctcggcgaagaaggcatccatatccgttgacgttgtttcagtaaatttctttatgttcttcaagattttttctctccctaactcggcatccgcgggctggtcatcacgcttggttcgaagggttccttcatttcggtgggtatagtagtgtttgtaacggttactgaatcacgtttaaaggtaaacacaaaccttctcctaatttctattagaacattgcgttttagtcagtcaatctgcttaaaaaaactgcaaaagaccttcttccaatttcgtaatgcaaaaatcataattacacaaataattccagcaaggaagccggaaagatgtgcaatttgtacaaatttttgcgcgtctgtcgcattctgtttcggcaatattcctaatataagagtaaagaatgccaccgttaaaatagccttcgtaattaaagaaaaatcaggtttctttattaaaaaagcaaacacggacattgggaacaaagcataaactgatatagacgcaccatagaacagacaaatgtatatgcttattcctaaggctgactgaatatacccgccaaacccaaagcagaaaataagggctccaatccaaccagaagtaaagaatccaatcacaagcgcgacacttccaattttccattctatgaaggggcctagaacaaccgttgggagaagattccacattaaatgattccattcaaagtgatatagcggaccagttattatatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactatataggaaaattcacctcttaaaactgaaggtatatttcccacaaagttggatgcaggaaccataaacgtattggttaaaattgaaaacaaaaagtagcaagaaactaatatacaacagatgacggaggtgcccttagctgctaaacctattgataaaagattcgatcttttcaagttctgtatcatggatatctaacctctttctttcgagtcggattcatgtctacaaatataagtattcaaaaaggcggacttgatctgttccgccttctttgttacctataggcctagttttgtttgatcataactctccaatcaaaaactagtttcttgcccaatgccggccagcattacggtattgatttgaagatccgtaatatggcgaaccatttgggcccggaaggtctgcaggagtaaaaatgtttctaccaataggcaaagcaccaccaccaccactgttgggtatgtgatcgccaccaattgtggtctgaagagtctcatctgagatcgtagtgatgctttcgaacttaatcatattaactttattcatgctattcctccatgcttgcgacaatagtgacattacgatgttaaactcatgagtgtagcgttaatatatcgcaacaaagtcaagtagtcaataaaaaatcaattttctgtagcaaaacgcttagtaagtattaaaaacgcaataaactaacattatatataattgttttaggccaaaaaagaaaatataaacttttgacgatgccatacggattgttaggaaagtaaagcgtggtcatagacacacaaaaacccttatgtggaaaatcgagccatattggcttttagataaattgactgaacgggcaattcccaccaagatgttcttgaatatttgaattgttgtccttcgcttgtgttctatatcaattagaagtttaaaaattctgtttgattggatggacgattggtaatttgtatttatgagtcatcctatagattggcgtttgttcatataacgtttggtttaaatctccacgatacggaatgatatttccgcccctgactttggtgagagaatttgaatctaactgtaagacattgtttaccagtttttcgagcattgaatatcttcctttccgaaggtgattgtttacgggactcactaaattagaatacacaacagtaaatggcacaaatcaattttccacaacactttaagaaaaaataatcaaatacattagtaatgattaaacgcattaaaaaccgtatgtaagtactgtacgcagtgatcactttgggtgtaattaatttgaacgccttgtcgatagttgaatacccagacattaatctttaacagatcaggatttttaatggattgagcgactacatgttgtcgcgcgtggcaacagttcatttcctatatatgcagggattacttgacatgctaagcgtcattgaggtgtttgggtttagattttgtatcgaggtacaaaagaggtcattattatgtggatcactaagcaacaacgaaaagattcaatcggcgggttaacattcctttatcgggtcgcaacgcgtgatccagtggatgcgcaacgaaggattgaaagaattattcttagaaatgcaatcaaaccaagtagagagaatttgacatttgactccttgggttgatacgcggtgtggaacccggattaccttgtgagaaattattatcaacttctgtttgaaatttggcattatgcagaaaaagtcaaaaaaggtgaaacagaatgatgtgccagctgtccctattcggtgaggtagctctattatcaagaaaatccgtgttcttatttatagatcgcgctagccgggagaaaaaaatagccgcttcccggacaggggaggcggctattgtgttgttatactgatttcctcaacttaaacgaactgtatcacatttgatcgttttagtcatctttaaatttaaatatcagcgagccggatttaaaattattgttgaaactagagcttttgaaagaaccgttgatgatgaaacgtaattttattgaaacaaaaaagaaaaaatcatttgcgaggaatttatgttgttacagaggcagacacgaccaacctaactgccggctataactatgttgagtataggatagcgagttactaaccttgcttcgagtaaagttgacaggaattgttactagttaaaagggtatgtgctatgaaatggcttagacttataagcattaaaagagtattgatatttggtgttattgctgccattggttgcaaagtaacagagctagcaacccacatagatccaaatgttgccagctatatttgggtgataggcctctttattacctataaagttgcagacgacatctcaattaaagttactgcaggtaaaaaaggggttaaattatagttgcttgacagtttctgatggatgtaatcggaatgattaatgtattaccgctcgcgcttaatcaagcgtcgcataatctttaacaagtggccattaattaaactgatcaagaattgtccaagactggcaaccagacattaaggtcacctatatgaagcgccaactatcattcagtgtaccccatctttcgaaagtatctttcaatgcttggcaacacctctggccgaagtggtggggcaatgaagtatagagatgttaagatccttttccatgcggacagtcgataataggcgcttaagtttgacggattctgatcgtagtctgcccagcgttgttgatcagtttttgcgagaacactcgttatttgctttaactgaacttggggactgcggctggcagtttgaatgattgtagcaagacgttcttcttcatcatcgaggaagggcgttttttgccagcttaaaatgttgggaataatcgctaaggcctgtttgatttgggcggggattactttggggtgtgcaactgcagcacttgccaagtcactaccatgtgcaacggcatgtgcccagcctttttcaggaataaagccacgccagtcctgttccaaacgaaggtagttgatagcccaatctaaccacgtattccgttgcttgatcgttaaaaaaggttcacgagcatctgtatccagaaagagagcgcctaataaagccgtgaatgtgcgcgtaaagactttatcactctgcggattgtcaatgccatcaaataattgcgctctttgagttgccaaatcggctaatagtttcttctgatgtttggtaaaacccggtgtttggaagccacgcgcgaacaaactataaacaagttgatcgcgaatcttactattggggtcaccaacatgatctagtagccaaatacactggttattcgtgaagcgcaatggatcttttgccaggctcagggtgacaagttcttggtacatgagagtcatctccttttcgatggtgagtcctttttaaacttataagacattataattttttggactcatgcagcccttgtatcacttgaagttaatcgttttcaactcggtcaaactttcggtagaattaagatgtgagaaagaacatacttcaagcaattcttttgaaggacatcaaaattgggtcaaattcttgtggcagtttagatgcagcacaaaaatagtcgtaaagttaagacagcaaaaagctcaagagcaagtgtctagatttactcttgagctttttgctttgtaaccgattgatcacaggaaaattactggaagcaattatatgggccgcggtttcttgtccatgaattgttcaagcatttttcaaatttatcatcgaaatgggttcgtggcccgtgttgatgaggagtgcctttgcccattccgttgacccagtttaaagttcccgggttataagagtcaccgccagagatctgctccaattccactatatccagaactgccaagctgtcttttcccaaataattcatcccctaaagagttttttgatagagctaacattatactatgctgaatgctctatttttaacataaataaaagaaaaagttttcataacactggttatgatgatattcttttgctcaaggggtgattcaaaatgaatgaaaaacaagtcattattgctaaaatgctggaattacaacatctttttgagaagcaaccagatggaatatcccaaaaggttgtcttaaaaataaaacaagcgatcggtaaacttgctagtaacaaaacagcagcaatcgatatttcagcacaagtacgtccgataagtcgttttatcagagatgaaatgttagagcatgattataatcttacgctagaacagcggacgctcctttttgacctagaaggcaaagcgcaagatattgaaaacaaattccaaacagcagcagattggatccttttttagcgactttgaacaaagcattgccaattaggcataacatgtcgtaaatatagccttatcctctttcgcacatacgaatctactcataataagtcgtgctgctcggagaataattttgtgtggtaattttaagagactaacaaatcacatgttaggatcaattggttaaaggtacccgaaagaatggcttttttgtgcgaaccttcttggcatacaagaaatgattaagcaagatagcgggtcaaaaaatacgtcaatttcaccggaatatgtgagattggcgtatcttcagaagtgacaattaacttagtacaaactagccacaaaaggcttcattgccgtcacgacatccccgctgccggtgccttcgatgagggcgacggtgaggtaggtgttcttgtcagcatccatggcgactaagaaaccattttccttgccgtctgtgtcctgtttctgcttgagttcggccgtgccggttttggcggcgatggtgtggccgtcgatggcgaggtcatgggcggtgccggcttgatcggagacaacgtgggtcaaagcagttttgaccgttttggcagcattgctttggagcacgctggtacgtttgccctttgcagcttgaatcaaggttggctgctgcatggtgccgtcattggcgatggcactgtacatcgccgcctgttcaattggcgatagcagcagctgcccttgaccataagcggtgtcggccaaaagcgtttcggaggcgagcttgccattgttggagatttgggcttttttcatggttaaaggtaagttggcttgggttttgaaaaggggctccagacctttgaggtaagcagaggcgcccattttcagtgctacttgagcaaaccagatgttgtcggagttaaccaaggcctgggtcatgttttccgggctggcgtcaacggtgcgggtcactttgtagtcgccccacgaactatctttttgccatttgagaccggaaatagatttggttgtgtcaggggtgatggttttgttttgcagggcaatcgcagccgttagcattttaaaagtggaacccggtgcgtatcgttgggtgaaccggctgaggaatggcagctcggtgttgttggcgtatttgtcatagttggtttggctgatgccgttcacgaaggcattgggatcgtagcttggcgaacttgctaaagttaaaagttcgccgttggttggatccatggtgaccacactgccacttttgcctgctagttgggtataggcggttttttgcttgttggcgtcaattgtcagcttcaggttcttgccggcaattgctttggtgtctagtaagggatggctgttgctgccgttgcgaatcgcgatcgtgccgccatccgtaccgcgcaagtaatggtcatagatttgttccaaaccggctttaccgattttgctgttggcagtcagtgacggatgctttttaaggtcatcggcggttgccgtaccaacgtatcccacgagttgagcagcagcctcgcccaacggataagtacgtgaaccgattgtttggtaagctgcaccggttaatgcaggggagtcggtgacgatcttgaccggcacaaatgtatcatcggtgacccaggattgcttgaggagcgtttcaagactcgaggttttcacatcccaggcggtcgcgattttttctagattagcggtccgttcatcgccggtacccagtttgccaggaaccaggccggcttgggtgacattgccgttggtggcgagcgcctggccattacgatcgagaattttcccgcgcgtggcagcggtcaaactaatctgaaccgtgtccttgccatccatttgtggaaacagcaggcttggcgtccagcgaatgcgccagttgtcgccgactttaacgatcggcgcggtgtaatgctgtgccgggagcttgccgattttggtgttcatattggcggtaaaagtgagttgataggtaccgtctttagaattagttgttttcagatccgtgattttgatgttgctggcgccgatccggtcgaaaacggcctgattgcgttcagccagcgtcttggcggtatattgccagcccggacctttgagatggctggtgtcgacttgtttaacggctttttcatattgacggttggcaaaagctttcgtgtaggcttgagccgtggccttaacctggtcgccttcagctttgccttggtaccagtgaaaggcaccgaagccacccacaatgacgacaattgctgcgaccacactaatcaggatggtgcgcgtcgatttcttcatgtctgttccccatttctagtttttacgcttctccatgtataacgccattctacgcttctgggtgaggggaagaaaccggggaaatataggcgcagggggtgaaggtgattggcaatgaggttgcttacaggaaaaaggccaccatgcaacatgaagcgcctctttatgaagactatttagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactatttacgttttagcttgtggttggcgcgaagaacaaggtatagtggatacaaaattgcaaagacgatgagggagaataccaataaattgaagattctttctgaagtcagccaggttattattaacgcaataataatgataacagtaacggtaatttgaagatgacgcgtattcataatttcctccgtctgatctaggttaatcgacttcatgttagtcattctttatgacatctttatcttaccttgtaggcgttattaatactagaacatagctgtccgtctaagagtcgatataagtcttgttccctgcattccaaaaaaatgggatgagttgatatgttggaggcaaacaatgagcgcaagaacagtcaagtttgatgagttcctaaaaaagcaactcgagaaccccgaatttcgtgagggatttgaagaagaaacctcaaagctagatagtgccgttgccttgatgagtgcaagagaagcacaaggattgacccagcgtgagttagcagaacgtgctggtgtgaaccgcaaataaagagaagtagaagtatggtgctaaaagaaatacgtggcagaaaagccttaaaataattgcttgcgcacgcaaataaatgcgactatactatcagctggaggtgagcatgtgttcaaacgctggctgatactcatgacgctcgggctgtttttctttatggtgattattgatggcaccattgtcgtcgtggcggttccaacgatcgcgcaggcattggcggtgcagcctagtcaggtgaatcttttgttgacggtgtatttgaccacgatcagcgtgtgtctgttgttttttggacagttagccgatcaagttggtcgaacgcgactttttattcacgggacgtattggtttttgcttggctcggcggtggctggattaggggtgaatctccagttggttttggcggctcgcgtcattcaggcggttggggcgagtatgaccatggcaacgagttatgccattgttgccgatgtttttccaccggcgttgctgggacgggcgctgggagttgagtcgatttttatttcgttaggcgcgctggctggtccgggaattggcggcttgattttaagccatctgccgtggggatttattttttgggtcaatttaccgattggcttagcgtgtgtggtgattgaatggctggtatttccgcgcgcatcacggtcgcaggcaaaagtacaactggatattcgcggattcctgatacttctactgctggggggattgttggtgatactgcagattaatcgccaaccccttgtgtcaggcgttttgctggcactgatggttgtcggcggtttgggattttggcaagttgagcgtcatgcagcccacgctttattggatgtgcagctgtttcggcaatccaggttcagccgtaatttaggcgcatcattgctgaattatatcggggcgtattttttcacgttgctggcgccgatttacttgcaagtgctgctcggcttgccggttgcgctggcggggatgttgttgatgttaccgccgctggtttcgctcgttgccaatccgctggcgggcgttttaagcgatcgcgttgaccaagggcggctaatgcaagtgggtctgggattgctggtgctcagtaatttggcgtttgccttggtaccaggtggccaacagctatggccatttatactggtcgccatgaccttcgctgtcggaaccgcgctgtttaccaatcccaacagcgtcatgctgattcaaagcgttgatgccaaaatgcgcgggcaggtgggtgcggcaacatcactggcacggcagttaggaatgagcatcggcagcgccttttcgagcttggtgttttatcaagttttggcaatgatgacgcccgcccgtaaccttgccaaaaccgcaccggcagcgttattggccgcacaacgagtgagtttccttgttgccgcaaacctctttttacttgccgcgatcatgttaagaaagaaggatggaaaatggattcagaaccagatgaactgatttcgcgggtgaacattctggcccgccagattcaacacgacttggatctgcggctgactccaaccagactcaatgccagtaattattactttattttgaagttaggcagcgttgacgacatgcggcaggatacccttttcaaaaagattcatcttaacgccagcaacgtgaccagacgcttggcgcaattgatcacgctgggactggtcaccaaggaaaaagcggcagatgataagcgcgcctgggtgatcagcttgacggcagaggggcgggcattggtgccgcgcgtaagccgaattgtcgccgagtacgaggcagagctgaccgcgaaactggcagctgcggacaaggttaggtttgaacaaatacttgacgtgctcaataaaacgaaagaggatgcgaatcgatgaaaaacgtgatggcgattttagggattccggcagattatcatgtggttcagacaacctcgcgaaccagaaacggtgaaccggtgacagtcgagcgtttgcagacttccgctgaaatcacgccaaacaacgcacacatgacgctggtccggaatgaagcgggaaccgtgatcagtttcaacgacagtacttttaaagctggtggaaaactgcctgctgctgaacgtgcgcgtcaccaagcaagccaactgtttcagcagctggattcgacatacgctgccaacttgacttacatgcgcactgaacgccaggagcgccactacttcgatcatggcgaacgcatcagcacaccggtttactggatcaagtttgcccaccgcaacggttcctacaactgggtgacgatcgggccggacaatcgcgttattgaagtggagcgcgagtcatactgggattactttaggaatcgccgcgccacggaaatgtggaattatgatgattgggtgctggcatatgaaggtaagggtccacagatggcggcaccgaatgcattggcgtgagtatcaggtgaaaagacaacctgctggtgagagagtgaaatacccttgatgaggcgagaaaagcagaaaggcagccttttggtgaaggaaaacacttttgaagtggtgaggagaagcaaaagggtagccttttggtaggataacgtcttgatgcgaagtcagagacagaaagaggcgatccagtggcaaaaccggattttgaaactttagtcgcgcggcttggtgacttacgggaagcggcgcgccggctggcagacgaggattatatcagcgcgcggtataagggttatagttcagaagggctcacgctggaggaagtgctggcgaagttggagacgacggagcatgagattgctaagttggagcgggcgttggaacggttggcggatgaggagtgagcttgtgaagcgcaaccgaaaatgatgcgtatgatagcaaattgctattgatttatgtcagcgagtttggcatcatcagtacgcggcagtagcttgagaaaagcccgctttggtgaggtgccaagacggttttctggcgaagattggctgctgggaaagaaaaaaccatcatggcgtcttgggataagtttgaaaagaaaatggatgcagtaatgcctccacaagaattaaacattattgatgcacttgccaaactccatagcgaacggattcggcgcgggatttcacagcgcgaacttgccaagaagattggcatgacgcaaccacagctagcaaaaattgagcggcttgactccgttccttctttcaatactttgaatcgttatgcagcagggctggggcttaagttgaagatttctataactgcttaaaaaatacaaacagcgatgcgattgacccgtgtggataaggagggtcaattgcatcgctgtttttatgatgtggcaggttattaatgaaatgtgtattggactgtcgggcaatgatgctaatctttgtctgaataaagatcttggcgaaaggtctatggagaattgaatgtcataggttattagcatgatcgtcaaaactttgtgatccacaaaagatttaatgtttcatcactgctgtcaatctccgcagcaacgccatggcctgcttacgtggcagtgtgccttcatcggccaaagctgtcaccgctgcttgcacaactcgcagataccggcgccatccggttgcgggcaaggattttttgacatccgccagcaatgcctgtagtgcatcgggagtccatcgcttgggtgtctgtaaggcttcagcgtacattcgggtgtggaagtcaatcatgaaagcaatgaaaaccggtgttggcatgcccataaattcggttgcgtaaagatctcttctccgtaaatgtgttgccaaggagaagccttcacgatacattcgattgccagttactgtcgtccattcgtagcgaccgatttttgtggcatgcggcacctgactagcataggcctgagcagcgcatacccacgtcatgtttaatttaaatcccgcgagactgaacgtattgcatctccgggagctctgagtaagtctcaagtccggcagcgttaagcaaagtgacgcgattgaagttatcaggactaattgagatcatgtggctgcggccaagcttggcaatacccttgatgaaagcgtcaggatcgggtaggtgatgctgaaccattaacgtcaaaaacacctgaagaatcacaagtcgattgccatactcttgcggattcttttgataaggtcgcagctgattgacaacggcggtcaaaatttgatcggtatcagtccaaccttgaatgccatgaccagtctgcatgtacatcgtcgtacaaaacgtctgcaaagttgtcatgacagtgtcttcatcggtgaaatttaggattttcgtcgggattggagaggtcatgaatccgaggagcgtgcgctggatgttgttgagctgtgcttgtgacatggtgggagtcctttcgaggaggaaagttcggatggggacgttatcgttatcataggggatgtagggctttcatacaagcatgattcgtgccaaaaaagtgatggcagactttttaaatttgcgctgatattttccaaatcaaggagatatcagcgctttttattagcaattgaacaaatacgggttaaagcgattatgaagggtgattaattgtttattgctggtattagcgcatcttcatgcgcaatactgatcaaggtacaattcgtgtcctaagtgaaggaaaaagggtctactttttggaatgtaagcgactgttcatctcgaacaaagttggtgaaaacaagaaaatctgcactttgtctccattgggtaatccgtggaatgctaagactgagagaggcgatttgcagattctttaaaaagaaaatgtaaaaaatgaccagtgcaatggacaaatctcaggtaagcgctttcaaaaaattcgaatatgcttaatgtacaggagaggctaactatgatgttaaaaaatggacgtgagtataaacttcaactttttttggcacagactaatgagtttacaactgctgatgaaattgccaaacatctagatctgtcgaagaagactgtttatcgtcttataaaacaaatcaataacgctaagccaggtctcaaggtaattgaatcggccaaggggaggggatatcgactaaatcacgaagagtttatcttacagcgaaagacatttcaaagtgatgttgcggaaatttctcctattactcggcaagagaaagtgatggaagaattgttgctggcatcgcctaagtggttgaagctgagtcagttgtatgaagacttttatgttagagattctacgattgcaaatgacgaaaaagcgattaataagcgtctttcaaattacaacttaaaattggctagaaaaaatcgagcgttacaaataactggagaggaacctgaaattagaaaagccatcgtggaattattacagacacttgatgttgtggatattgaggacctgaagagcacgacaaatagcgaacttaatcaatttgatgtcgcactagtaacagagcaaatcggcaaaattgaaaagacactcggcgaaaaggtcccgtatccctacaatgtcaatttgttttcacatctgtatatccttatctcgcgagtgaaaaaagttgcggtagacactggagatcaaaagctaactgttcaagagagacaagtgatgaatgatgagccaaaaattgccaagattgcagaaaagaccattcaaagtatcgggatatatctcaataaacaattgcctgaagttgaacagtattatctctttcaatatttaatatcttctagattacctgaccaaactagtcaagttccaaatttttcagatgaagtcacaaaggtagccgatttttatttgtcgaaagtcggtcaacgtctgaacttagcggtcaatagttccacaatctttcacgaattagctaatcacgtaaagccaatgttgaatcgcttgagaaatggtattcgtgtgaagaatgttttattggagcagataaaactttcatatcagggtgttttcaaaattgtgacagaggtttcaaagatagtaagtaagaagtttaatttgcccgtaataagcgatgacgagaatggttttattacactttattttgctcgcatgaatgaggcccatcaattacctatacgtacacttgtcatgtgtactacaggaattggaacatctgaacttttaaaaacgaagctaaaaaagcattttccggaattggagattgttgacgtcattaatactcgagagtatcaacaatatctcgaaaaatatccaaaagtagaattgatcatcacaacagtgggccttaaagagaaagttcccattgcatcgttgctagtcagtgcaatgctgacgacagaagatcaagcaaggattcaaaagacaattgagggaattcggcatgaaaattgatcggatcttagtattcactaatgtcaacttaaaaaccagagaggaagtttaccagtttgttgtaaagcaagaattcccttctgacattgagaatgcaaaaaaactttctcgcgaattagtggatcgagaagcccaaggaaatattcagattgcggaaagtattgttttgccgcacgctgaatgcaactacattcaaaggtctaagcttcttttaatcaaaactcaaagaagcattgacacgtggtcttctgatatccatgacatcaaagtggtgattgtgatgcttcttaagtcggatgaatctcgtaacgtcaaaatgcagttcgtagatatcatgagacagcttggtaaggatgaacttatagagcaattgctatcggaagatgatccggaattgttgctgaaattgttgtcctaaccatcaaaaaatgtttataaatgcaactcgaagtaaaccaaaaaattaactaggtggtttggagtatggatgtaattaatattattgatcctaagatcgttgatacgagattaaatgtgaataataagtcggaagttgtaactaaattggctcaagatctatttaccaatggctatattgatgatgtttctgcttttgttgacgatgtctatctacgtgagttggaaggccagactggcatcggtggttatattgccattcctcatagcaagagtaaacacgtgaaaaaaattggtgtggcgattggaattaacaagaaggaaataccatgggaaacacttgatggaaaaggggtaaaagtagtcatattgtttgctgtcggagacgacaaggagtcagcaagggatcatctgaagcttttgtcactttttgcaaaaaagttagggagagaagaggttgttagtcgtcttcttgatgcaaaagacacgagtgatgttattgctgcgtttaaatgaaaaggagtgtttgagatgaagattgttggtgtagcagcgtgtactgttggtattgcgcatacctacattgcccaagaaaaattggaaactgcaggtaaaaacgcgggttctgaaattcatattgagacccaagggacaattggtgttgagaacgaacttacccccgaacaaatagaagaggctgatatcgttattttggcgattgatgtcaagatttctggggaggagcgctttaaaggtaagaaaatcattcaagtacctacagagattgccattaaatcgccaaacaaattgattgccaaggcaaaagagatcattgcagcatctgtctgaacttaaatgcacactagttgaggagggataaagatgaaagcattaaagtcgctcaatcttaaaggaaacttgttaaccgcgatttcatacttgatacctattgtttgtggagctggttttctcattgcaatcgggatggcattcggaggacacgcgcaagatgccctagttcagggtaaattcagcttttgggatgctttggccacgatgggcggaaaaggacttggcatgttacccgttgtgatttccacggggattgccttcgctatcgctgctaaaccaggtattgctccagggtttgttattggcctaactgctaatgcgattagtgcgggtttcatcgggggaatcttgggtggatttattgccgggtatctggtagttgcaattcttaaatatgttaaagttccagcttgggcaaaaggattaatgcccacgttattgattccttttattgcttcaattataggtggacttgtaatggtttacgttattggaggaccaatagcagcctttacagcgattctgacaggttttctcaagggactaagctcatcttccttacttgttttcggggcagttattggtctgctaagtggtgttgattatggcggcccaattaacaaaacagtctttgcgtttgttttgactttgcaagctgaaggtttgaacggaccgattacagctctgcaattggtcaatacagcaactccaattggttttggcctagcattctttgttgcaaagttatttggaaaaaacatttacacgaaagtagaagtagaaacgctaaagtcagctgttcctatgggcgttattaacattgttgaaggagttattcctttagttatgaatgacattgtccgaggtgtcattgcaactgctgttggcggtgcggctggtggtgctgtgtcaatggtgatgggtgcagacgccacagtaccatttggcggattcctcatgattccaacgatgtctcatccttgggctggtgttgctgcattagttgttaatattttggttactgcattcacattggccctcataaaaaagaatgtgagtgaagaagatttagagaagataaatcaagctgaggaagaagatatcgacttagacgatattaaagtcatttaaaaaccaagtttatataattggcaaatgaaaggaagcaaaaagaatgaagttttttcttgacacagcagatgtagaagcaatcaaacgaatcaataaattaggccttgtagatggtgtgacaaccaatccaactattatttcacgtgaaggcaggaatttcgaggaagttgtcaaggagattgcaaaccttgtaccaggaccgatttctgcagaagtgacagcaatgaaacctgaagaaatgattcgtcaagccgaacaaatggtcaaatgggccagcaatattgttatcaaacttccaatgacagaggccggcttgcaagcaaatcattatttgactgatgaggggattaagacaaatgtaacgctcgttttctcagtgactcagggacttatggctgcaaaatctggagcaacttttgtatcaccgtttgttgggcggttagacgacattggcacagatggtattgaattagtaagcaaattaagaaagatatttgatatctataattttaaaactcaaattattgcggccagcattcgtagtcgcgcacatgttgaatgtgctgctttaagtggtgctcacattgcaacgattcccccaaaactctttaatgaattacaaagtcatccactgaccgatcgtggtattgcgcaatttgctgaagattggaagaacttccaggaaatggaggtagtaaagagtcatgaataacattcagttttcaccgtccttaatgacgatgaacttaaatcaatttggtgaagagctaaagtttctgagcacaaaggttgattcgttccacattgacattatggatgggcactacgtaaagaatctcagtctatcaccctggtttattcaagaagtaagaaaggtgacgtcgcttcctctttcagctcatttgatggttgaagaccctgctttttgggttaatcaactgataaatttaaagtgtgaatggatttgtatgcatatcgaagtattgaatggcatcgcatttcgtcttattgatcaaattcatgaggccgggttgaaagctggagtggttttgaatccagaaacacctgtcagcacaatccttcctgttattgatctagttgacaagattacgattatgactgttgatcctggttttgccggccaaaggttcattgaagaggcgttgagtaagattgtggatttaaaagagattcggtcagagcatcattatgattatttgattgagatggatggctcatcaaaccgcagaaactttcccagaatcgcggaagcggggccagatatctatatcgttggccgaagcggtttatttgggctaacgaacaacattgagatgtcgtggggtaagatgacacaagattttcaagattcaaccggtttaaatctaagttgagtagaggactcgaacggtgttaacaagaaattctgaacctcctcaatgtttgattcgatagatgaacaaaaagtaaacaccttatgtatcttgtattaaagcattagggaccgttgaatcgcttgattatgaaaaaatcaaacagataaatttgaaagcgcttttcccagtgcagctatttctcatccagcggaaagacctgcacagctgtcttaaatgcatttggtagggcgcttctggggagaatttatattagcgactactgaacaaatcgatgagaagtcgcatcgaaagagggtgttcgaacaatgcttgatgatttaatcactcgggaaatgattcaattttctgataagacattagattggaaagaggcgatcaaacttgctgcaagacctctgaaggattttggctttattgaaccgcgttatatcgaggcgatgattaacaaggttgaaaaatatggagcctttattcatatagggaaaggcatcgctttgcctcacgcgcggccagaagaaggggcgaaaagggtaggcatgtcagttctaaagatgagccatccagttttattactgggacaaaaagagcatcccataacagtatttatttgtttgtctgctgttgataatacaatgcatttaaaagcattggcacagctgacaacgatactttccgatgagcataacttggcgtgtttgttaaacgctcagaatgatgaagagatcatctcagtattaagtgaaggagcgaaataaaatgaaaattgcagctgtttgtggatctggactggggtcaagtttcatggtcgagatgaatattcaaggcattttaaaagatcttggagtaaataatgtggaaactgctcattttgatgtcggtagcgcgatggaagggagtgccgattactttttcgtggggaaagatttagctgatagtctcagtaacttaaagaatgtgattgttctcgacagcattattgataaaaaggaattaaaagaaaagttagagccacttctaacaaaccaaagccaaggttaaatcgtcgccgaaaggaggattaataagatgaatggattcttgaaggtcttagttgatattgctagcacacctgcaattctagtcgctttaattgcaatcctaggtttggttttacaacgcaaacatgttagtgatgtgttgaagggtgggataaaaacttttgtggggtttttagtgttaacgtccggcgcaggtgttgttacaggatcgttgacaccgtttggaaagatgtttcaacaagcctttcatgtcacaggggtggttccaaacaatgaggctattattgctattgcaatcaaaaacttcggtaccgccactgcactgattatgcttttcggcatggcagccaacattctttttgcacgattaacgaagtttaagtatatcctcaattttcaagtcaagtgcaacgatgataacgaattcttgatagtggtctaggctgttacgccatgcatcggtagtaatcgcatgggcgaagatagttcagaatacgtctgggacgatggttcagtgcggattggactgcttgaatttcaaccagggtaactgctctgagggacttccctttcgggaagaattccctaagcagtccattggcgttctcgtttgtgccacgctcccaaggcgagtacggatgtgcgaagtaaatctgggttccaacaatctctgataacttggcaaactcggaaccattgtcaaaagtgatactctcaaattccttggccccgtagtcgtcgatcgtgtcctgcaaggctttaaggcaggtgtccgcatgatagtcaggaatcttgacgatgatctcagtccggctgtaccgttctgtgagcgtcattaatgctggctcatcagctaagcgaatacctttgaccaagtcgccttcccaatgtcccacgcctgtgcggtcattcacggccgcaggacgcaactcgattgagtcgccgtatatcttcttattcttgcgcttgtgggcgttcttatagcctttgatgcggcgtcggagcttcttgggaagtgtcatgttgtctagcgcaagcagcccggcgtcgatgtagcgatacacagttgtcgttgaagggcaagccttgccctggtcgcgatagaagtgtacgaagctatcaacgctgtgtacgcgcggcttacgagtaagctccctggcgagagccttgaagaacgcacggccggtcttaagaaaggcgtagtgaccggttctatcgcgtttacggtcgtgcatggcttgggcagtttccgcaagatagacttgatgcgagtgacgcttcgagtcgagctgagttacagatccacgcgtgatttctcgtgagattgtcgctttactgcgatgaagcttctgtgcaatcacggtcgcggtgtcaccagcagcctgaagggcctgaattgtagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggaagtttaagtatatctatttgactggtcatgcctttttctatcaggcatgtattatcgcggtggttttgactacaacaggaatgaacaatgttcttatgattgcggtgggtggcctttttctgggaatgtgtggatcggtctttcccgctattattcaaccctttactaaacaaattactggtacagatgatgtagctttggctcacacggggaactttggctatatgatcgccggttatattggaaaatggtttggaaataaaaataaatctacggaagatatcaattttccgaaaggtttggcctttcttcgagattcaacggttagcattgcactcactatgatggttgtgtacttaacggtggcgttattcactggatcaacctatatcgagactaaattgagtgcagggacaaactttatagtattttctcttcaacaagcgggaacatttgctgcaggtgtttatattatcttagctggagttcgcatgatcttggctgaaatcatccctgcttttaaagggatttcggagcgtttagtaccaaactctaaacctggactagactgtcctattgtctttccgtatgctccaaatgctgttttgatcggattcttttcaagctttcttggcggaatcgtaagtctcattattatggcgctgacggggacaacgattgttattccaggcgttgtaccacatttcttttgtggagcaacctcagcagtctatggaaatgcgactggaggaataagaggggccgtcctgggatcattcgttcaaggcgttgtcatcagcttcatgccgttgtttttaatgccattagtaagcaaccttggctttactgggtctactttctcagatacagattatggcattatcggtttacttctaggccaatcatcacgaatgggaggacagatcgcggttattgcagttattgcagtcgtagggatcacaatgtttttactcacagcagttagtgcaaagaataaaggtaaagatgaagaagcagcttaattttaggaaggtgaataaagttgaaacaaactgagttacgtgatattaagaaactcgctgcaaagattaggtatggtgcgatcaagtcaattcagttggctggtcagggtcatattggtggatcactttcagttgctgatctgttagcagttctttatggaaaacagatgaactttcgaccatctgatcctcactgggcaagtcgagactggttagttctttcaaaagggcatgcagggcctgcactgtatagcgctttagcagcgacgggatttattgactataaggttttggaaacattaaatcgcggtggaacgatacttccttcgcatcctgatcgaaacaaaacaccaggagttgacgcaacaactggttctcttggtcaaggtacatctcaagcagccggtattgcgactgggctgaaacagagaagattatcttcctacgtttacttgattgtaggcgacggcgaactaaatgaagggcaatgctgggaagcctttcagtatattgccagtaacaaactgaataattgtattgtgtttattgataataataaaaagcaactagatgggtggacagacgatattattcgtcaattcgacatttctgaaaagatgcgtgcatttggttttacaacgctacatgtcaatggaagcaatgtagaagaaattgatgccgctattgattacttgaagacaattaaagattcagcagtttgtgtcgttcttgatacagtaaaaggggcaggcgttaaatttttcgaggaaatggcagataatcactctgttaagttcaacaatcctcagatcaatgccaagactgatactgtactagaagaattaaagcaagtctttgaggaggaagaaaatgtttgaactagatgctaaaagagaaataggaaaagagttgcggcagacagttgtagatgcattggatacattgatggataatgacaatcaaatcattgcgcttgatgcagatttaggaggagccagcaactttcttaaattcaagcaaactcaccccgacaaattcatcgatgtaggtatctccgaagcgaatatgattggtgttgctgctggtctcagcttgacaggttataaaccatttgttcacacatttgcaccatttgttgcaagacgtgctttagatcaattatttgtatctggtgcgtactcaggaaatactattaatatctttggatcagatccaggatttgctgctggatttaacggaggcactcataccagttatggagatgtaggtattctccgaaccatcccgaatatagtcatttgtgacgctgcagatgaagtacaaatgaattggataattcaagctttcagtaaactgaaaggaatccattatgttcgggctaatcgaaagggcgtacgagcaatttataagaagaattcacaatttcgacttgggaaaggtaacttacttcaccgaggttctgattttctgatagtggcggcggggcagcttgtctcggaagcactggatgttgctgagaggttggagagtcaaggcatgtcagcagatgttatcgatatgtttacgataaagcctttagataaggacttgttattgcatagattaccacaaaagaaagctgttattacaatagaaaaccataatattattggcggcctgggtagcgcggtggcggaagtaatggcagaaaacaagatttcaataccgctaaagagaattggctgtgacgaccgctttgggcaggttggaacaccggactttctgcaatcagaatacggactaacctcggaaaaaatttataacagaattaagccacttctcgtcttggcagaaggtcatcgcgaagctgatttaattgccgtaaagcatattgataatctagaatagtagtttattcctttagatacggaagattagcatgtgtgcatgaacaaggattacttcaactttttgaggtgcagattggttgctataaaacttagaattttaagcaaataatgttcgaaatagttgaaacccctttcaccgtgatgtaggataatgttcgaggtcgaacatttcgtggaaggggtgtttttatgttaggcgctattgaagcaggcggaacaaaatttgtttgtgcagtgtcaccagatggtcaaaaagtagaacatagagaggaatttccgacactatcacccgaagagaccatggtaacggtatatcattattttgaacatcacccagtagaatcaattggcatcggctcttttggacctgtcgacatcaaaaagacatcaccaacttttggttacattgaggagacgccgaagcaatcctggcagcattttaattttttaggagaaatgcagcgacattttccgaaaattaaatttgcttttacaacggatgtaaatgcggcagcgtacggcgagtttaagaaaggtgcaggtcaaggcgtttctgaccttgtttactggactgttggtactggtattggagctggggttattttaaacggtcaaatactacaaggttatggtcatcccgaagctggacatattttagtgaaacgccactcagaagatagcttcatcggtgtttgtccatatcaccatgactgcttggaaggcctagcttcaggaccagcaatggagaagaggtacaacacatctgcaaagaatatttcagagaattctacagcttgggttatagaagcttattatcttgcacaggcatgtatgacgctcacattaactgtggcaccagagaaaatcatctttggaggaggtgttatgcatcagaagcaattaataccgttgatccaaaaagaatttaccgaacttttagctggctacgtgaaaacacctcctgtagatcagtatattacttctatacagttgcatgatgacgctggagttattgggggttttcagttagcaaaagacttgtaatggatgttaaaaaagcacacttcacaggggagtgtgcttttttatatcctcatgtgttcaagggtttcgcaacgacaacagagcaaagcttctttaagtctctgatgaatctgtcgctgagtttggaatcaacgatgattcctgaaagctcattaatatttgcaaacggatagggatcggccttgccaatctttgtagcatcggctacaacatacttttttaaggcacgtttagctgcgagttcttttattgttttatctggcaagctagaggttgttgcttggccattatagatgccattcgtaccaataaaggcgaaatcaaaataaaagttttctaatgcttgttctgctattgcccctagaaattggtttgacttttcttcgtatgtgccgccggctaagacaacttttgcttttcgttttaacagatctcggaatgctaaatcggaattggttacataaagaatctgtggatttgttggcagaaacgatattgccgcgtttacagtcgttcctgcaccaagataaacagttgccttgggtgttataaacgcagcaatctgtcttccgatttcaagctttgcttctcgttgaatcttagctttttcgttggttgtgcgttcaatgatcaatgaggcgccaccgtaagttcgtgaaagaagccttttttttgacatttctgctaggtcacgtctgatggtcattggggctacttggagttttcgagctaattcgactgttgtcatagatttactgtcggtctcccctaagagctcaagaattgcatcctgtcttgggactttcatgtcactccctcctatcctttctcatgttccaattatattttacctgtcaacgatgttcaagtatgttcatcttagctaaagaatattggatgaagcgagcatttgaaatttgcattttatatagtctaaagaaaaaagatctaaaattgttgacacaccgattgaaagcgtttactatgaacttgaacaaagacgaacacataaagtcgagatgaacatttgttgggaggagaaatcagcgtgaataccttcgatatttcaaaagtattgaatcaaaatctcatcactcttgatctaattgcctcaaataaggaagaagccatttccgagttaaccgacctcttggtagcagaaggtgcggtaaacgacaaaaaggcttttgttgaggatgttctcattcgggaaacggaaggaatgacaggcttaggtcaaggcgtagcaattccccatggaaaatctaaagctgtatccacaacttcactagctatcggtgtcagtaatcattttatagagtgggagagtttagacggaaaaccagttaataccattattttattcgcagttcgcgatcaagacgcagatacacttcatattaaattattacagaaagtggctatcttgttggcagatgatgagtttattgaagaactccacaaagcaaaaagtaaaaaacaagtattaacacttttcgaaagaaatccggaggaggaatgaaacaatgaagattgttgggatcgcggcttgcacatctggtattgcacacacgtatattgcgcgcgaaaaggtgttgaaagcagcaaaaaaattgggctgggaagcacacatggagacacaaggaactattggcactgaaaatcaactaacccctgagcaaataagtgaggctgattttgttcttttggcaatcgatatcaagattggcggacgtgaacgatttaaaggaaagagggttatcgaagtacccacaaatacagtgattaaagcgccaacgaaagtattagaaactattgcaaagaaacttgatgacaaacgtaattccactaactaattcttgaaaaggaggagcatcgtaatgattaagaagctccagttgcgtaaacatgcaatgaccgcaatttcgtatatgttgccactagttgttgctgctggtttattaatcgcaataggcaacctaactggcggaaaagtgatgacatccttcaagggtgactactttctaccatcagttctgacaacgcttggcgtgtggggtatgggattactggcacccgtcatttccgcagcaatcgcatattcaattgctgatcgaccgggtattgcgccaggtttactaagtggtgttatttcgtacaacattggtgcaggtttcttaggtggtatgttaggtggttttattactggctgggttgtcgcagctcttgtgaagtacatcaaagttcctgtttgggctgaagggcttaagccgatgatgatcattccgctattatcatcgttgattatggcaggcatcatgttttatgttgtgggtcaaccaattgtcgttgcgacaaatgcaatgacgagttttctcaatagtatgcaaggatcggcaaagtttgtcttcggtgggattatgggggcgatggccgcttttgatttcggtggaccagttaacaaagtcgcgtcactatttgcagatggacttttattacaaggcgttcaacaaccggaagcaataaaaattttagcttcgatggttccgccgtttggggtcacaatttcttgggtactggcgatattattcaaacgaaagatatataccaaagccgaagaagataatatcaagatagcctttcctatggggattgtcatgattactgaaggcgtcattcctatcgcagccgtagatttagttcgggttgttgcggcttcctccattggagcagctgttggaggcgcattatcaatgacttgggatattaaaagccctgtgccatctgggggaatgtttattgtacctgcgatgaataagccattgctattttgcttagcactccttattggttccattgttacgggattaattctctttttcaccaagaagacggtaacaaaagatgatgaggtgctggagtctggaaacggtgcaaatgaacctgaggaagagatcgatttagacgacattaagtttgacgaatagggggaccgttcatgtacgtatccatgaaagagatgctagataaagccaaccgagaaaaataccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgctacaattcaggcccttcaggctgctggtgacaccgcgaccgtgattgcacagaagcttcatcgcagtaaagcgacaatctcacgagaaatcacgcgtggatctgtaactcagctcgactcgaagcgtcactcgcatcaagtctatcttgcggaaactgcccaagccatgcacgaccgtaaacgcgatagaaccggtcactacgcctttcttaagaccggccgtgcgttcttcaaggctctcgccagggagcttactcgtaagccgcgcgtacacagcgttgatagcttcgtacacttctatcgcgaccagggcaaggcttgcccttcaacgacaactgtgtatcgctacatcgacgccgggctgcttgcgctagacaacatgacacttcccaagaagctccgacgccgcatcaaaggctataagaacgcccacaagcgcaagaataagaagatatacggcgactcaatcgagttgcgtcctgcggccgtgaatgaccgcacaggcgtgggacattgggaaggcgacttggtcaaaggtattcgcttagctgatgagccagcattaatgacgctcacagaacggtacagccggactgagatcatcgtcaagattcctgactatcatgcggacacctgccttaaagccttgcaggacacgatcgacgactacggggccaaggaatttgagagtatcacttttgacaatggttccgagtttgccaagttatcagagattgttggaacccagatttacttcgcacatccgtactcgccttgggagcgtggcacaaacgagaacgccaatggactgcttagggaattcttcccgaaagggaagtccctcagagcagttaccctggttgaaattcaagcagtccaatccgcactgaaccatcgtcccagacgtattctgaactatcttcgcccatgcgattactaccgatgcatggcgtaacagcctagaccactatcaagaattcgttatcatcgttgcacttgacttgaaaattgaggaaccgagaaaaatatgcggttatggcaataaactgtttcaatcttgagagcgcacacgctacgattgctgccgccgaaacaaaacgagcaccaatcatcattgacctgttgatggagcatatggaaaaacatctttcacgtgacgaactgcttccttcaattatcaacatggcagaaaaagcgagcgttgacgttgcattgaacttggatcatggaaagagcgaacagtatgtgattgatagcttaaacgcaggtatgctcagcgttatgatggatgcttcctcttatccgtttgatgaaaatgtgcgaatcacgaaagatgttgtcgagcttgctcataaaaagggcgcgactgtggaagctgaagtcggcaatatgggagctgtagctggatcaaactttactcaggaagatatgtatacaaaaccggatcaagcaatatctttcatcaaacagactaatgtggattgtttagccgtttccttcggttccagtcatggcactatgcctgtagggtatgaaccacactttgattttaatattgtcaagcggatcaaaaaagttaccggcaagcccttagttttgcatggagggtcgggatcgggaaacgagaatattagaaaatcaattgaagcaggcatcaacaagattaatgttggatccgatgtcatggatgcgcagtctgtagctatctttaaccaactggtagaagataagcactcggattttgttaatgttatgagcagctcaattattgcagcgaagaaggtggtagaagagtatatcgaattgtcggggtccgtagataaagccgctttgcaaacaatcacccagtaaacttgaggaggaatttcaaatatgcttatcaatatgaatcaaatgctgactgtagccaagaaaaaccattttgctgtaggggcatacaatgtatcaaacgctgagttattaaaggcttccgttgaacaatgtgaggctgacaatgctcccggaatcatcgctgttcatccgactgagttagcttacgcaaaagatgatttcttcgcttatgttctgcaacgtatccgaaatagtaatgttccattcgtacttcatcttgaccatggtgatactattgaaaatgttgaaagagcaattcatgacggctttagctcagtcatgatagatgggtctctggaggactgggagaaaaatgtcgcgattaccaaggaaactgtcaccatttgtcatcgccttggcgtttcggtagaaggtgaattaggtacaattggacaaactggtaatcatattaaggaacacttacaaaatggcatttatacgcaacctgatgatgctaagaaattcgtagaggagaccggagttgatactttggctgttggtattggaactgctcacggcatctatccctcagatgtcacgccaaagattcgtattgatatcttgaaggaaatcttggcagtagttgatgtgccgcttgtcttacatggcggatcctcaaatcctgatgatcagattgccgaagccgttaagactggtattgccaaagttaatatttcttctgattataagcatgcattctttgttcaggctcgtaaggttcttgcagaagatgatggctgggatcccaataatctcttcccaacagctattgaagcagctaagaaggttgttcatcacaaaaataaattatttgattctgtcgggaaagccagtctttacgctggcatgaaaccatggcgatcagagcttatctaattaaacaataaccagccattacccagatcgagaaggtctgggtttttatggtaatacatttaataatgcctcatttttgatgtgtctcggggcatgctgtggaatggttggtaaaggaaaggatgacttggccaataggaattatagtgcgtagctaaaaaccaagttgtctgtcaaaattaagattaagcacaatctgtctaaagtgttttcatacctttatggcacatgtggtatccactttataaggagtggcggtaagatcaaaagaaagttgtaatggaaaatagcagtcagatccagcgtcatacgctgctggagaagtagttggcaagctccgtggtgacaaccaaattggtaagaactcagtagcagatgttgttatcttcagtccgcaagcgggacgacaacaatatagcgggtctggtagtaaaaaagtgcttctcaaaatgagaagcactttttcagcatgaaaattaaagagcctatgcagataggaggttaatcttgtataggctcaaattatgggaaaacaaacgctggcttatttgtttaaaaggtctttgagttcaaccttgtcgttttgaggcatgatttgaatgaagacatgcacacccttatccatcagtcgcttaaaggtctcgttctctgcagaactagtggagattgtatggtataaccgttctctaccttgttttgctcccatgccgcctaaatcaatctcgtcgattgcaataccatgatctatcaaatactctaaagtttccggtacttttaccagaatgatcgttggcgcttcgagtggttcagagagaaacttaacgccatcttccttgtcaaaaacgccaatagccatagtttcgggaatcgcgttttcaagaacgttaatcataaagtcatcctttgcgacatcatcatcaatgacgagaacttgttcagcgtttgtgatccggctccatgcagtcattacctgtccatgaatgagacggtcgtcaattcttgttaagactaagttttgcacgtggattgccccctttttttaagtcaattagttcaactccagaattctgcgggtttagcgcaatttctgttaattgttgaagtgtagaagtttctgttcgtgatgtgataactgaaattaaaataggtatattcattcccgtaattaagttgaattggagtgtttgttttaaagacgctgcagtgttataaggagtgccgccctttaaatcaacaaacaccattgtttttcctgacaaagaggataaaagctcattcaccttacttcggtagttgtcggggctttctccttcgtgaagttgaattgcgtggattgctttttgtggtccggttatcatttctaaactctctaacagaccttcgcaaaatggaccatgacttagtaacacaatattgaccatagtaacctcctcggtgtttaggctttaacaattccaagtacatttaaataagatagaagtattccaacaacaaatattcctagaatgatccaagttgggttgactttcttacgaaccaaataccaaacgagcacagtgattcccagtgggattaatcctggggcaagctggttaagaatattttgcaacttcattgtgctcttgccaactgtccaaactaagggtgtccgaacagatacgcggctagctgccattgcaccaacgaccattaggccaacaatactgaatgcgttggtgactttactgattaatccattttttaagattgagataaccgattgcttacctttgcgataaccgaacataaacatgatataaccaatggtgtagataacgagttcgaaaatgagggtgaacataatggggccaagataatttccttgtaatgccaaggatgcgccaacacttgcaaggatagggaaaaagattccttgctggacggtatcacctatgcctgccgcgggacccatgagaccggttcgcactgagttaatatcgtctgcagaaacatcttgaccgttggcgcgagcctcttccatggagagtgcaacaccgtgaatgattggtcccaccatgtgcggttcggtgttaaagaagaccatgtatttttttagctcatctgcttggcgcgattttggataaagtttccgaattggatgaatcatcatattggtaaggccgagtgcttgaagccgttcatagttgtacgctgcttcatcgccttgctcccataaccatgttttaactaaatcagagtgtgttaattttttcgtatattgaatagtagcagggtcagatgagtttgctaccgaagtctctgaggctggcttgacttcttcggcagtaccatttcgattttgaagtgtaagccgacgcacttttttctttggagaagatgaatgagctgtttccttattagaacggctttgaccaataaacacaaggaatgcaatgcacgctgagaagatagcaattgccatgatatcgagctttaaatatacggtcaagaaaaagccgataataaagaaagcattgagttcttttttaccaagataattcagcaacattgcaatccccagtgctggcataagtccgccaacgacttcaagggcagttgtgaactgagcaggaattgcagaaattaatgatgttgtccatcctttgccaaacataaccagacaaaatgccggaatgccatatacgataaaagacacgatgaaggaaggtacatagtttaagaagcgaatttgattcacctttccttcatccaaggccttgtcggctcggtgaacccaaaatgagttgacagtttgataaatttggaccattaaaagtcctaagagtgagaatggaattgcgaacgtaacggctaatttagggttagctcctgataagattgttaaggctgacccatatataccagctaccattgtattgctcggcataacgccacctgcgttgatccagccaagataaactagctgaatatttgccccggctaacatgccaagcattgggtttcccatgaagataccaactaacaagcctgttgtcagtggataggtcatacatcgtgtaatcggagcaaaaaaccaccactgagaaataatcgcgagtaaggcaactaaaattgctgataatagcattgttaacccctccttttacgggaactgctatgtcggcgactataaaattgaaaagcctaatgcttttacgtcattatggaatcctttgactgtatcaagagataattctgtcggatccaatccaatcattttcatcttttcaagaattggattagtcacggtaataatatcgataccgaggttttcagcttggaagacatttagaagttctcttgaacttgcccataacagacttgcttggggatattgattgaccagggcctgactctgcttcattaaaggaactggatcgacaccagtatccgctaggcggccggcaaacaccgaaatgatattttgggtatctttagataatgcttcagcaacggatttaacctgtttgtaggttagaattgcggttgcattaatttggataccctcggtggaaagctttttaatgagtggaacagaggattcgcctttggtatttgtgattggaattttgacaaagacgttttgaccaagagttgccaacttttcagcttctttttgcattgttgtgaagtcgtcagcaaacacctcaaatgaaataggcagaccatcaacagctgccagtgcttctttagcaaaacttaaataatcagagactccggctcttttcattaaagttggattggtggtaaaaccgctaattggccatttggttttagcttcaatcattccgtcaactgaggcaccatctgcgtaaatagagatattaaagtcactcattttgaatccctccaagtttaattttgcggtaacgtttacgcaaagcccaaaaaattgagccgttctttgcggcaactttgaaagtacatgacattgataaggtcacttgaatttggtattattgtgtaaacgttttcgcacctttcagatattattaaacaacgatacctgtgaaaagtcaaacaaaaaacttggtgatcttaatggcaaacaaaaaaaacgcttcaattaaagatgtcgcaaggttaagtggtgtctcagttgcaactgtttcaagaattatgaacgacaccggtagatattctcccaaaactcgagacaaagtgcttaaggttattgaggagattggatacgaacgcaactccttggcaacgagtctacggatcaataaatctaatatgattggtatcttggttccggatattgccaatgagttttatgcctcagtattaaaaaagtcagagcaggctctttttaaacttgggtactctacgataatctgcaatactgaacgaagcattgagagagagacagcttactatcgaatgctaattgaacatcgcgttgatggccttatctcagtttcaagtgccagtaaccaaatgccattatctgcaaagtatgctattccaattgtttttatcgaccgtgatccacactcgaattcagagctaattgtgactactaaccactatgcagctgggaaagagttggctaaacttctgcttaatcaagcggacgatttatgccttgtcatgacaaaatcacgtccatcctcaactatggatcgagttcaggcatttaaagacgaactggcaaagagcaaaatggacacatcaggaaggatcttgtcgttaaatacaacatctgataagtttttacaacctcatcctgacctaaaggagtttattgagaagaagtgtcataaaggcaaaaggctgggtgtgtttgcaattaacgacaacgtagcctatatggtattaagagttgctgatgaactgggtcttaaagtgcctgatgaactaattgtgacgggggttgatggtatgtccattgcatcgatttcccaacctacaattaccaccattgttcaagattcaacggcgattgctgatgaagccagtcgtctactagttgagtcaataaagaagaggggggaaaaagaacgattatcaggtactatttacattccttatcgacttgcacagagaaagagcacactaccaaaaaaataaaatccagctgaaataccgttacaagttatttgaagattggtgttgcttttttgtctgcgtacgtgtgcatatttgaaatcaaggcattgggatcctaacgcgcacattcatcacctcggaagttacttcctctataaaaaagttagaatactttgttgactctaaatgtgcaagggcttacaatattgttgtgaatcgaatatacagaaaaaaatatattcctctaggagcgccagaaatgaagacttatcaatatcaaaaaaagggcttagcactcatctttttagcgaagaaattctttgtcttgaaggttggtgatcgtattccaacagtctccgaaatgatcagtgagtccgaattatcaagaggtacgattcaagcgggacttgaattgatgaaagcagatggcgctatttcaacggtttcgaagggacatcttggttcttttttagtggctcaagatcaagataaacttttggcatatttggattatcggaatgttgtatgtgctatgccacttccatataccaaacactatgaaggtttagggacaggtctttataaggcgtttaaaaatcaaaagctgggattgaatgttgcttatgttaatggttctgtgaatcgtttagaagggttgcaacgtaatcgttacgacttcatcattgtatctgcgctcactgccgattatttgactgaacatcatgatgttgatgttgttggaattatgcctgagggttcatatgtatcacgacacgtcattgtttataaggacgatagaaagttcaaaatgcgggatggacttcgtatcggtattgattcacattcgctagattataagttaatgacgaacaagatcttggagaagcataaagtcgagttgattgagtcgccgtataatcagattgttcaaagaatagtggcgggtgagattgatgcggctatttggaatcttgatgaagtgaagtcaaagaattatccgttgagttatcagatgattaaagatccaatggtaaagcgggcatcaagagccgctattctctgcgcaaaggaaaatgaatttgttaaaagagtgattggtgattacgtggactttaaggaagtgacagccattcaacaacaagtgatttcaggagaggttttaccagaatactaactaagttatattctacgaggaggtgagacaatgtgagcgatgaaactgctaaaaagctgcagattttatatgatgttggcaagctgagtgatgaggatcttgcatttattcgtttagctgatcaatatctggttaggacagtgggcgagagagactccgagatgttcttaattcatctatcaattgcattggaacgcagtcacaagcaagaacctgtggatgcattgccggataacttatgggcggaagtaacagctgatccagaatacctgaacgctttgaatatctggaaacacattgcagaatctcgaccagttaatttttcagattttgaaacacgctatattatcatgcatttggttaatatcctgaggaggggttaacatgacaagaattgtcattggtggtcagatgggaaaagaagagttgaggcaggaacttgagaagctgactgccgggaaagatgttgagattagtgttaagagcgatcttgatgctgctatggcggtaaaagataataaagcagacttttacattggtgcttgcgaaaccggagccggtggcgcattagcaatggcaactgccttattaggatcaagcaagacgctcacagttgcatcaccctcaaaggttttgtctgaagaagatatcaaagagggcattgataatgggaaggttgcatttggttttacaattaatacaaaggacacaattttaccaattcttgcaaagtatctgacaaagtaagcttttatgccataaatcaatatactgtattctgtatattgagaaaaggagggtgtcaaaatgaacgtttcggtcttaatagactacgtgttaattgcgctagtcggaggcgtgggctctatcttagccaatcgcggaattgcagtctttaatgatggtttgcgaccaattatgccagagtatttggaaggtaagattgatcgcaaagaattggctgccaccagttttgccgtcagttttgggttaattatcggctttgggattcctgtgtctattggttcaacaatcttggtggctcatagtattttgctcgctgccgatattattggtacatggacaccagctaacaaatggggaactgcattagcgggcgtggttggtgccgtttacggtgttggtcttttgttcgggctatcatttattgtttcagcgtttaagatgctgccggttaacttcttaggagcgctgtcactgttaggtggaccgattctattagccttctgtgcgtttccagcactagccgttgcaagtcagcatggggcaaagaaaggcatgatcacatttggagcgacatttgttgcttaccttcttgctacaaaatttggggtattctcacttggtaatggtatcaaaattactttaaatccaattgggatgtcactcttagtagcaatgttgttcatgctttactttgctgctcaaattaaaggcgagggcacttcaaatgcaagtctcgtaaacgtcttttcagcgcgtgtttctcgaattaaaaagaattggatttggttgtccatcatgggtggcttaatcactgctgcatcaagtgtcctgattattgcggttgatgttttgccacaacagttgttggttaaaggacaagttatggaagctgccattgcaacattggctcgggcaattggatttattccgctggtcttctctactgccattgtaactggtgtctatggcatggctggtactacgattatctttgctattggacttttactgaaaggtaatccgattgttgcgtttatcgcgggatttgtttggatgtggattgaagtacaagcgcttgctggtactgctaaaggtttggataaatttcctgggttgcgcgatatgggtgagcatattcgaacttctctcactgatacgattgccatcgccttgctgattggtgctgcattagcctgcaataagatggctcccaaccttggctacttttgggtgattggggtctggctgctgaacaagaagctgaaaaagcctcttgttgatatggctgtgggtccaattgctgctatcgcactgggaattttattaaatctgttacgaatcgtacatctgttttagctgatgacgaacggattaagggaggaaatatgttattaccaggtaaagtctatgctcatgaacacattccaattgacttgtctgaagtcaagcaaaatgaggattgtcatctagataccattaatcaagtgattgcggaattcaaagatctttatcaaaaaggcgtgcgcaatgttattagtatgacaaacaagggtatgggtcgaaatataccgtatgccaataaagtagcaaaagaatctggcatcaacattgtgcaatgtaccggtttctatcaggatgcttttttgccaattgaagtttttcgattatctgttagtcagttagccgagcaaatgatcaaagacattgaggtcggtataaaaggcactgatgttaaggctggtgtgattggtgaaattgcaacgtcaaagggtcaatggacagcggccgaggaaaaagttttccaagctgcagttatcgcccaaaaagaaacgggttgtccgatcagcacacatacctcaattggaaccttgggtcatgaacaagtagctttctttaaaagacatcaagcagatctgagtcatattgttatcggacatgttgatctgacgggtagtgctgattatgtcttagagatgctaaagacgggcgttaacgttgagtttgacacgattggaaagaataattatatgcctgatgcaacacgagttgagatgttaaagaaaattgagaaggcaggatttatggaccaagtcgttttgtctatggacattacacgcaagtctcatttgaaagtaaatggcggaaatggatatgcctatttactggattcgtttattccacagttgaagagagcaggtatttctgaaacctttatcaacaaaatgttagaggaaaatccacagagaatctacggtgatatcaatgcctaagtttaaaacttatcccttggaaagcataggttacgaagaagcgttacaaaagcaatttagcttggtggatgaaatcacacgacaattcaagggttccgaaattctaatgcgcggtgacttgggtgttgtgcgtggccttaatcgacctcggtatacagaaaaagtagaaaaagttcttgctgcttatttccacgcggaatctgcaatgctagtccgaggcgcaggaacggctgcaattcgcatggcgttgcacagttatctgaaaactggtcaaactttattaattcacgatgctccagtgtatccaaccacgcaaacgtcaattgacatgatggggctgaaaactattcgggttgatttcaatgatttaagcaatcaggacttacctgagaaaccagatggcattcttgttcaatacacacgacaaaaacctgatgattcgtatgatatgggggaagtcttggcgttctttaaggagagatatccttctgtgccaatcattacggacgataattacgctgttatgaaagtccgaaagattggcgtcgaacttggtgctaatttaagctgcttttcaacattcaaattgttagggcctgaagggattggctgtattgttggcacaaaatccgcgatagagaaattgcggtctgaaaattattcaggtggttcacaagtacaaggacacgaggcaattgatgttttgcgtgggttaacttatgcacctgttgagttggctattcaagccaaggttgtgactgagctagttaatcgactgaatgctgacgaggttcctggaatcttaaaggcatacgtggcgaatgctcagtcaaaagtcttgttagtggagtttgacaaaccaattgctgaggacgttttgaagtatacggaagaatttggtgcagcgccaaatcctgtgggggctgagtcaaagtatgaaattgtgccaatgttttatcgtgtatcgggtacgtttaagagattcgatcccactcttctgacaacgacaattcggataaatccatatcgttgtggagcagataccgtcattagaattttaaagctaagcgtagagaaggtgatggaatcatgttcttaaagcagttggaaaaacaaaatcccgaattgattcggtatgcgtttgaattgcataacacaggtagaattcttccggatacgtatgtgattgacttggacatgatctttcaaaataccgaacacattgttgctgaggctaaagaaaatcacgttgagttgctttatatgacaaagcaggttggccgaaacccggtgattgcaaaagaagttgtaaaggctggtattccagaagcagttgtggttgattttcgagaagccgagacttttatggaaaatggattagctataggaaatgtggggcacttggtccaaccacccaagcattttctaacacggcttctgagatatggaacacgatatgtaactatgtattcgcttgagaatgtcctggcgttgaatgaagctgcaaaagcagtaggtataagacaaaaagtacttttgaaggttgtgggtaatggtgatgatatttatccaggacagacaggcggttttacattatcacaattagatcaacaactggaacagatcaaggcacttacaaacattgaaatttcaggtgttactacattccctgcaattctatacagtgaatcaaagaaagatttcactgcgacaccaaatgtcaggacagttaagaaagctaaagagatttttgagaaccacaatctaagcacgactgttgtaagtttaccgtctgcaacatcgacaacttcactgccgttaattagacaattgggagggaatgaaggagagcctgggcatgcattaacaggaacaacacctttgcatgcggttaaggcccaaccagaaaaaccagcttactgttatgtgagcgaagtttctcatacgtttggaccgcatagttatatctttggtggcggattgtatcggcgtggtcatctaaaaaatgccttagttcaggatggtaatcagtatgcacatgcccatgttttacctcttgaaaactcaagtattgattattatttagagttggaccggcagtttaagtcaggtttgcctgtaataatggcgtttcggacacagatttttgtcacaagaagtactgtagcactggttcgaggattacacacagctggtaaatcgccagagttggtcgggttgtatgacagccaaggaaaaaaattaccagaaaggatgcaatgacatgggaaaatttggtgttattgttttagatagttttggcgttggcgctatggatgatgttcctcaagttcgaccggatgacatcggttcaaatactgctttgaacattataaaagcagtaccacagattaaaattcctaatctagagaaacttggattaatgaatgccattggtcaggaacgtggtgatcacaagttttctcctacagctaactggggaacttccttactgatgcaccatggcgctgattcttatcttgcacaccaagaaattatgggtacaaagcctaagatgccactgcttcagccgttcaatgaagtgatcgacacagttgaagcacaggttaagaaagatggattcgatgtcgagcgttacggtgatcccgggtaccagttattggtcgttaatcattgtgcgacaattggggataatcttgaagcagatcctggacaagtttataacgtaactgcggcacttgatgaaatgccatttgacgaaattacacgtttgggagaatcagttcgtagtgtggttaaagtctcgcgggtcattgcatttggtggccgaggcgtagatttgaacaatattttggcagctcggaagattgaacacgagaagtatgtcggtgtttcagccccggaatctggcgtttacaacacagattaccatgttattcacttaggttatggcattaatcctaaggtacaacttccttcaattcttcaagcaaatggtattgacgttgccttggttggtaagacagcagatatcattaatgttgatacaacgcggaagttcccaggtgttgatacgaactatctttttgataagtttgttgagcagtcgaaggatatgaaagatggccttttgtttatgaacatccaagaaaccgatttggcaggtcacgctgaagatcctgttcgatacgctgaagtacttgagacagctgataaacgattaactgatgttttaccgttatatacgggtgacgatattttaatagtcatggcggatcatggtgatgatccaacgattggatttagtctgcatacgcgggaacgaaccccgctgttaatttacaaagaaggaacccacaataaatatgttggggagcgctcaacgctttctgatgttggagcaaccggatcagattattttgatgttcagtttccagaaaatgggaagagcttcttgcatcgcataatcgatggaacggatttagacgcttagttatgtcagtagcaaatgctggtcttgtgagatcgccatttgctatttttatttgtctcgatgaaaacgtggataattattgtcgaataaagtaattcgtgcaggtacttttaactggctggtcatgaaaaagaacggtacgaagctctggattgtgaaatgaattgtactttcaatctttacacccgaacatttctcagctaaactctgattacattcagtttccacagaactcacaaacaagtaccaaaactgaacgaaacacagcagcatctcccaacgaacaattggtctgaggatgctgctgagaatacaggaggcgagtagatggcaaagttagtgttgcagacagatttcggattggtggatggtgctgttgcggcgatgtatggggtggcttatggtgttgatgataagctgtcgattcatgatttgacgcatgagattccaccgtatgacatttttgcggcgtcttatcggttgtatcagacgacgaagtattggccagcgggaacggtttttgtttcggtggttgatccgggggttggcagtgatcgacggagtattattgcggagacggcggaccatcattttgtgattacaccggataatgggacgttgacgcatttggcgaagtttgttggtttgaagcgggtgagtgtgattgatgaggcggcgcatgcgttgcctggcagtcaggagagtcacacgtttcatggtcgggatatttatgcgtataatggcgcaaagttggcgagtggccagattacgtttgaggatctagggacgccgcttgctgctgatcagattgtgatgttgccgctgggcgaagtgacgcagcaggaaggccaaattgccgggacgatcgatattttggatattcggtttggttcgttgtggacgaatattccgctggatgcgtttaagaagcttggcgtggcgccaggcgagttggtgcaagtgtcgatttattatcgtgaccagatgcggtatcaaaatcagatgccgtttacgcggacgtttgcggcggtgcgagttggcgagccgctggtgtatgtgaattcattgctgaaccttggcgtggcgattaatcaggattcattttcgaagttgtatcatattggtactggcgttgattggcatatcactgttaagcggctttaggtataatgaattcattatgaaaatgttgcgtcagctaatcattcgttgacgttgtggcacgaatgatacgaggaggatttttatgcgagatcacaaagttttgagtgtccgaacggttgttgcaatcgggattggcactgcaattttatttattttaaagcgctttgccgttattccaactgggattgctaacacgaatatcgatatttcttatggtttcttgggctttattgcaacgctgtttggaccgatcgccggcttctttatcggttttctcggccatgcactgaatgactttactcaatacggtcagccttggtggacatgggttttcactaccggtttggttggctttgtgattgggctattttggcggcggtttaacgttgaagccggcaattttggtgcgaaaaaaattgtggcgtttaacgttttgcaggtgattacgaatgtggttagctggagtctgattgcaccgacgctggatattatcatctatagcgaaccggctaataaggtttatgttcaggggattgtttcggcaatttccaatagcatcgcaactggtgtgatcgggacgattttgttggtggcgtatgcagcaacgcggacacgttctggcagtttgaagaaagagtcttaatatggcggcaccagcaattcaacttgatcatgtgacatttcaatatgacagtcaggctgaaccgaccttacacgatattaacctgacaattcagccaggcgaaaaagtcttgattgtcgggccatccgggtcaggcaaatccacactaggcaacctgattaacgggctgattccacatgcatttcccgggaaattaagcgggacagtgaaggtgaacgggaatgttgtgcaggatcagagtctggctgcgttgtcgctgaatgtcggaacggtgttgcaggacccagatgcccaatttgtcgcgttgacagccggcgaagatattgcctttgcattggaaaacagcgccgtggctccgagtgagatgcacaccagagttaaaaagtgggccgagcgtctgaaaattggtgatttattggcgcaggcaccgcaatcactttctggcgggcaaaagcagcgggtggcaatggccggcgtcttaattgatgaaggcgacattttattgtttgatgaaccgttggcgagcctggatccggcaaccggtgaagcatcagtggcgttaattgatgaactgcatcaaacctatcatgtcacagaggttatcatcgagcatcgactggaagacgtgttgcggcggccggttgatcgcgtggtggtgatggcagatggccgtattctcgctgacgacaccccggaagtattgttgcgtggccagttgctccaaaaaatcggattacgcgagccgttgtatcttgaagcagctgagtttgcaggtattgatttgaagcaggcaacgcacttggcaaaccttgaaacattcgacgccccggatttaggcaccaaacttgcagcgtttaccactgaggcgccgaaaacggtcgccgatcagacgcaaacaccgctgttgacggttgccggcttacaatttgcgtatccaaaaggccgccagattttcaccgatttgaacttaacgctgcatcatggcgagatggtggcgttggtgggacgcaatggtgtcggcaagtccaccttgagccatttgattgcaggttttctgaatccgaatgccggccagattacgctggatggcgaggatttggccacatggtcggttaaagagcgggcagataagattggctatattctgcaggatccgaaccagatgattagcaagcatttgatttttgatgaagttgcactgggaccgcggttacgtggttgggatgaagaccgcgtcaaatcggcagtgctatcggcgcttaaagtttgcggtttgtatccattccgttcctggccgattaacgcactgagttacggtcaaaagaagcgggtgacgattgcagcaattttggtactagagccggcattgatgattcttgatgaaccgactgccggtcaggattggcggcattttaccgatatgatgcgctttttgaccaagttgaatgatcaaggcattacgatgatgttgattacccatgatatgcacctgatgttggaatatgcgcagcgggcgattgtgcttggcgatggcggcgtcttgatggatgccacgccggccgcggtgttgaccaacccggacgtgattcaacacgcctcgctggcccaacccagcctatatcgcttagccaaacgcctaaatcttgacccactggcgtttacccaagcagtgattgatcaggaacggagggtgcgccaatgaattcactttttggatacgaccctcaagacacgtggctgcaccgtttgaccggagcaactaaaatgttggcgttcattggcatttcggttattgtcatggccagttacgacacacgcttcgtttgcgcagtcatgctggcatcaattattttattcttacaagcaaaaattcactggcaccaaattagcttggttatcaaaattattaccatttttgcggtcgtgaacctattactggtttatgtcttctcgccgcaatacggggtggggctctatggaagcaaacatgttttgatccatgccggctacctgaccctgactcaggaacagctattttatgaactgaatctcgctctaaaatacattgtgaccgtcccgctggccttaatcttcttaatcaccaccaatcccagcgagtttgcggcgagtctcaataagttacacgtgtcgtatcgcatcagctactcggtggccttggcactgcggtacattcccgatgtccaagccaacttccgccaaatcagcctagcccagcaagcgcgtggctatgaattatcgcgtaaagccaagctgttccaacggttgaaagggatggggcagattctcatgccactgatcttcacaagtctggatcgcatcgatcaaatcagccaagccatggaactgcggcgctttggtactggtaagcgtcggacgtggtacatggaccagccgctaagaacaccggattggttggtgctgggcggcgttgtggcgattattgtggttggattggtgctgtttcgggttaatggcgggcggttttttaatccgtttaaaggctaactttttaactgaatcaggtaatagtgcaggcagtcatcgcgttatttggcgcggggatgcctgcattttacttcttgatccaaatgcaaacggctggcaatctcagaaaaaacgatacgcaacacaataaaaaggtcgttgcacgtgaacacacaacggccgaatgtagtaccaacttaatagtggcacacagaacgatgcaactaaaagccgcagcataccagtggaggatgccgcggctttttattcgtctttttctcaagataattccagagcctgtatgtgcagatgaacatatacaggctctggaatttaactaatcacgtacacacagtaacccgaacgacaaatctacacgtgcgcggtagcctttgccgttaaagtcttagtggcaatggtgaagtcattcaaattctcttgatcaattgcaacacccatgccgggtttcgctggaacattcacataggtaccgttaagtgtgatcagtggtgtgataatatctcggtcatagtaacgtgtcgaggctgcgatatcgtttggcaaagtatagccaggtaatgtggcgattgcaacattttccgcacgggcaacaccagaatctaacatgccgccgcaccaacatttaattccgttttgagcggccaatgcttggatttgttttgcaaccgtcaagccaccaacccgtgctactttgatgttgatgattttaccgctgcctaaacgaatcattttgcgtgtatcgtctaagctcgtcacactctcgtcaaggcagacaggggttttaatcagcttttgtaggtcagcatggtcaagtaagtcgccgggttcaagtggttgttcaatcataataaggttgagatcgtcgaggcgtttaagcgcggcgaaatctgctcggcgatatgcggagttggcatcgcccatcaacatgacgtttgggaatgccttacgaacagctgcgagatagtcgtaatctttaccgggctttattttgcatttaatgcggcggtatccttgttcaatgtagccattcacaactttaacgagtgcttgcggtgaggcttgaacgccaattgagacgccggtttcgactttttgcttgtcaccaccaagtgcagtagcgagcggcagattagcttgcttggcaaaaatatcccaaagtgcgcaattgatggctgatttagacatgttgttgcggcgaattcctgctaccagtggatacatatcatttggatggggaatatcaacgttaagaatcatcggcagcataatattaagaagtaattcccaagcaccggcgcgaaattcctcattataaaatggaatatcgaaagcggaaacttcaccgtaaccttttgtgccgctttcatcggtcagctcaagaatcatcgtctttttggcggtcattcgtgtaaaactggtttcaaaaggatggcgtaaaggaatatcaacttgacgtaacgtagcagaaataatcctagattgcataattaaagttaccacccagaaaatgtgaaaaaagacctgtccttctttctaaatggcttgctatgcaaacaccattttagcaaaaaagggcagattttttcgtttttggctaatggtagctctcaatatgggtatataccaataagcggtgtgctttaattttattattacaaagtatcgatacaggtggaaagctccttattagaattaaaattaagggtataccagtttaagacagcgaaaaataatttttttattgactatattatataaatgcgtttacaattgaatgtgtaatcgcttttaaaattcattttagcaacgcgtataaagctatttttttattgctagactttaaacgaccgttcgtaaattctaagcatgtgagcttttatacttaaatggtaaagaaaattggagtctcgtatttttttgtcagtgcttaactacgggaatatccatttaaaaatgattaccagtcactaacgacgttggaattaatcgacttcgagcaaagcaatgggaggtgagaatttttgaagcttcgtgcaaagactatcgtaaacaaatacgttgaaggtttcaggcttcttgttacaatgacggcgtaaatggaatcgggaaggaatttcaaaagttttttatcaattactgtagttcttgaacacgatgacgtttgtactgctcaacattcactaaatagaaatggggaccagaaatgaaaaagctgacaaggattattttttgcgttattagttgtgttagcctaatagccagttcaataggactctattcaactccaaaaatcgtaaaagctgatactacatcagtgaccgatgccgatattaatgcctatatttctaatatgaccttagatcaaaagattggacaaatgtttgtgtctcgaacattgcaagatacggataaagctcgatctgatatagcaaaatacaaccttggtgggttgattgtatatggagctgatttcactagtgttgaaggaaaaacagctaccgaagcacagaataatttcaagatgaaggtgcaaagttttcaaaactcagcaagcctgccgttattgattggtgttgatcaagagggaggaacagtttcacgcttatcacaaaatcctctaattgcgaatggtagaagctttccttcaccacaaacggcttatgctaatggcggaatggccaatgtaacaaaagaggctagtgaagtcggaactattctaaaaaatctgggcatcaattggaactatgcaccagtagctgacagcacgcctgatacttctagttttatttatggcagaacttttggtcaagattacttggcaactgcaaactatattacgaatgtgatccctgcatggcagaatgctggtgttgcagcaacgcttaaacattttccgggttacggatcagcgattgatacgcatacggattttgcagttgttacaaaatctaaggcggattttgaaaaagaggatttgcttccctttaaatccggtattacagcaggagcagattcagtaatgattgcacatatcgtaatgcaagctgttgacccagtatacccagcttcattatcacgaaaggtcgttacagacttgttgcgtaatgaacttggttataatggcttaatcattaccgatgcattggaaatgggagctatcaagcaatttgctcaagaacatgatcaagttcctgttgatgttcttgctgttgaagcaggaaatgattgcatcatgaataatgattatgaaaccgctattccacagattcatgcagcagtaactagcggcactattaaggaatcagaaatcaatgaacacgttttccgcattctagatctcaaacgcaagttagggctgttaactaaagcgcaacttcagcaaaaaaaggttcagattgacaatgtttcctacagcagtgacaacaaaaaggcaacagttagcggcacagttgttgatagtgattggcaagttggagaaccgttatcggttaaagactcaactggaaaggtcattattaccgcagacgtcggggccggtggtaagtttactttcgatattcctactaattcccaagaacaagtattaactctgaccactaatctacccaatatcgctgatgccaaaataactattaaggctgtgagttcatcgaatactaacaaaactttgctagaaaacttgattaaatctgttgaaaaattagctagcaatcaatatactgtcaagtcttggcaagagttgcaagctaaactaactgaatcaaaatcaattttaaacaatgatagtgctacacaagatcaagtagatgcttccgttaatgctttgcaaagtgcccttaagcaattagtttctgcatcaaatagcgaaaataatagtcaaaactctaatgatagcagttcccaaagttcatctaacactggtggacaagcatcatccagtactagtaatgctaatgagactaatattgctagtaaggatttgtcaggtacaaagtcggataaaggatctaaggacaatcacggttttttgccaagtacgggtgaacgcgtgatggcaggaatttctgttctgggggtaattttaatagcttgcgtgactgtattatatattcgaaaaaaaagggcataacttctaattattgattagtaaaactcattagaggccgccagaactcacttggttctggcagtctttttttggctttacgtcaactggtgttgaagcataaatttatctttgaggcggttctccatttggggagccgtctttgtcatgttatgccgtgatttggtagattcgtttgaagaagttcagctgatttttgaagccaaaacaggatcgtttgagtgacttgatgaggcggttaaccccttcgatcggaccgttggaataagagctggtgacagcggcgagaacagcgactttgtgtcgcttaaacgttgtccattgccgtaccctttggctcgtaagtagctaacaggtttgccagttccgcgggatgtttcttcaccatcaaagcatcatgaagcgctaagtaggtctcatagggttgcttgagcttgggctcagtatcaagtcctagattgcaataataaagttaccacctagaaagaggcttgctcactgcttgaactggggtttgccaacgaagacattttctaggtttgttattgataaacgctgtggctcgttgaatattggcctctgaaacctgatcaaactgtgttcccttcgggaaatagtagcgaagttctcgattgaaccgttcgttcgtgccccgttcattcgggtgataggcatggcaaaagtaaaccggtatccgatagcgctttgtaagcgcctgatcgcaggaaaactctttaccgtgatcaaccgtcactgatcgaaccggacccggaaagtctaccatcagtcttgcaaaacccttgagaacagcatttcgtgataagttttcaagcttagttgtcgccattaaacgtgtgacccgatcgacaatggtcaaaacagcagcctttgacccgcgaactgtatccatctctaaatgtcctttttcggttcgccgattagctgactcactgcaaatctcaattgaggtgcctactgcttggttatagcgcgaccgaaggtcttgtcttcttttatgacgtttaccgtgatcaaagagttgacttggctgaaaatcgacttgtctttgataaatccagtggtaaatcgtgtgtggtgcacagtgaacggcataaccgaccatttcaggggaccaacctagggttagcctctcagttaccatccgcttcaacttaggcgttaaaatcgagtgccgaccacaacgatgccgacaagtatcggcatgatcctgagctataatggcgcagtaatcgccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggcatcttttcatctttatctgcgaccctatttaggagatcagacagattcttacgaagatttgtcggtgtatatatctccattggaattcctccctgtatatatgtacatcatagcgcacgccaatgataatcacgtttcgtctttaatttcgatagggtgtaccctattgtaactaatacgaatggagagtattattagttacatataagtgacccggaggtgatctagaattgtctaaaatcggttatgcgcgtgttagtacgcgtgatcaaaatctggcgcgtcaaattgaacagctacatgatgccggtgttaataaaatctttcaagagaagctttcaggtaaaaatgccgatcgtcctcaactgaaagcaatgttagactatattcgtgatgatgatgaagtagtggtactgagccttgatcgacttggtcgcaattctcatgatttgactgacatcatcgaaaccattcggcatcgtggagctcaattgaacgttctaaatctacctagctttgcaagtattgaagatcctaaccttcgtaacttgattacgacaattattgtcgaactatataagtatattgctcaagaagagcgcgaaactattaagatacggcaacaacaaggcatagaaattgccaaacgccagggcaaatataaaggcaaaattcgcgaatatggtcctcattcacctaatcgtcaaaaacgctatatttataaagaagcctgtcgccttttaaataggaagaaagacggagatgaaactctgaccaagcgacaaattgcccgcatgttaggtattgcaccagtaaccttatatcgcatcgaaaagtatcaggcagaagatctagcaaatgttcctcgtagtgagaggtaaacatcatgatagatttaaggggcaaacgaattctctttaccggccgtttgcgatcttttcgtcgtttccaggcacaacagttagcaactattctaggagcaaaacctgtcaacgggattgacaaaaatgttgatatccttgtggttggtattattagcaaaccctatgatcaactacttaccactcaaaagttaacgtatgctagaacctatggcattccaaagattgacgaattagcctttatttcatggtgccaatggcgattagatcaattgaaagcaactctttaagtgccttcttatcaaacggggggaatagtatgcaaaagcgtatcgatttggccaatcaaacgtttggacgactcacagtcattagtttttttggaagcagttctaatggcaacgcgctttggctctgtcaatgtcaatgtggaaataaatgtattgttgacagtcaacgacttcaaaaaggattcactcgcagttgtgggtgtttgcgatcagaaataagcagattaaacataaaagctaataaccagactaaaaaatacatgggcaatcccaagaattttcaactaatcaatcgaacaaatttagttgcttctacacttaaacggtccaataacaaatctggcgttatcggagttagttgggataaaactgctcaaaattgggtcgcaaggctgtactttcaaggccatcttgtcctaaatcatgtatatgttcatatggaggatgccatcgctgctcgcaaggcagcagagaaaaggtatattgtacctttgcaaaagcaatataatcaaacacaccaaaaaaaatcaattaaattgattagacaatccgatctggagaaaatgccattacctgcactttctatagatttatagaaaagccgattcattataaaatggttcaattccgtaatcatgcaactgccctaaatactaagatcagtttgcaagaaaagaagccgtagcgtgtgtttgtggcatcaagacttaattcgacaaactcccaggacaacaattattgggacagcgtcgtgaaatggaaaaacgaggttatcatctagatcagaaacagtgtgatcctctgtatcaaggccaacattgcctagcatacaagcaactaagtcctgttgcactcacaatgcccatctatcctgagtatgaccaaggatataaacacgtttgcctaactaatctaacaagcaaaaggatcttgttaacctttcagcgatcctagtctgcggtgttcatctggggacataggattgacaaaataggatattgacaaaacagaatatcggcaatatacttactaaaagtaattggaaagcgtaatgtcgtgttgatcggagaaaattaaatggtaaatcttacagaagaaatgaagaatatgttaaagagtcagctccccttcctagcaacaacaggaatagatggcaaacctcaagttggtcccaagggctcactacatgtcttagatgactcacatttaatctactttgagcataccttcaggcaagcctatgataatctctcgagcaaccatttggcagcgtttgcggttgctgatagaggcgctcaacagggatttcgctttgagggaacggctcatattcatgaaacagatgattttgctaatcatattttagatcaaactaacatttttgaccgttttccacgcgctggcgtagtggttattgatgttgaacgaatctataaattggataacaccttagaggctggcattcaaatcgcctagggttcttaaaacaaattcaaccgagtaagtcgaagaattttttagtgtccaaactcatacagtgcttatttcatgtcattaagtattcattagcaagcagttttgttatactttgtttagaagtgatggaagtacgtcgaattcttaagaaaccatagcctactgttaatgccattacttagagcgtgtcgatttttgacacgctttttttgtgccattgggtacaaatcatccaataaaaattaaatatcaaaaaagacggcttccactatggaaagtcatctttgatgaaccggttttctaatactcattcatgttgcatcgtcctacttcaaaagcttgaaatatacagacatagtgttttaataagttggtcgtttttagtttattaaactcaatatcagtcttaaaatattgatcctttcctcatttaaattaacccaaaaggatattaaacaaattttaagatcttaatgatattcttttaattgaaagcttttatcccgaatttttttgacataagccttgtacttagtccggccaagcggtgtgacaattgcgactcgataatgattaccaggcaggctgatgtcagtcaccccagtttgatctgatttaaaagaatgtatatgtcgacctcgtttcaccacgacttgtgtggcttcagccggtacttccagcaaataatgctttcggccaagcatcaaactgcgcattacgaaaccgatcacgcctaaaatgatcaccgcgcctaaaagtgcgactattagctttaatttgttccaccaaaccgcccaacttgaagcctcttcatctgccttaacgtaaggaattcggcgacccgttatcaacaatcgatgagaattgatcatataaggcgtgcaggtcattaaggtcacaagatcctgtcccggcacaattcttagctgccgggtatcacttggctcaataacctggcgcttaaagacttggtaagccaatttatgattgcctatgctaataaaaaacttgtcgcctttttttaacgctggtactcgggtaaaaagttcagcgtttggcacaccacgatgcgctgaaatgacagcatgggtatttttaccaccagttggataacttgtaccatccaataaacaggcgccaaattgtagaagccaatcgcttgtatgatcaaaaaccggcagactaaggccaattttgggaatcgtcaactgagcaactgtctgccgagtcaagatttgttgattgcgtttggctgctgtttttgcggttccttgatcattaacagcatgattaaaactggcaacgccgggcacttgttgacttgctgccaactgtttatttttttgctgatagtcgttatattcccgccgcaacaccatctgattcttccgcgcttcttgttgtcgatacctgtcgatgacttgctgattttggtaagaaacgtaagcatcacttgcaaatggatagcataaaacaccaaaacccgctaaaagaagacatccaatcacaatatcaatcaagtctaaaggtcgacgtgttcgttttgtcactctgattacctcgccatatcaaaacaagagcgccatcgacgctcttgcttgactcatttatcttattaactttttagaaaccattgcggcgcttgcgataggcaactgctccaaatgcaattaaggcaacgcccaaaatcgcaaaaatgactgtgccagtaccaccagtgtgtggcagaataccgcttggtgcatctagaatgtcgctagacgaattatcagctttaaagtctgtattggcagcagcatcataaccatccggcacgtttgtttcaactgccgtgtaagttgtggtgttatcagcaaatccatttaagccaaacttaccgctcttatcagacgtgaaaacagtagcatcgctttcagcaacccacgtcaatcgatagttattggccaatacatcgataaatccttcgccgatgctgacgctttgaccatctttatctgtcaacttcaaaaacttgccatcactattgctaatcttaaagccggctccttcaagcacttctttagtctcagcatctttcttaacaaaagtgcgctcataggtggtcttttgaacattctttgggtagacatagacattcccgtcggctgctgccttggctggtaaggttaaccagaaatcggcagacgtgttataaccagctcgcggattggtttcatggaaaagatagacagcagcacgagtcttaccactggcatcttttgattggataggtaatgcttgggttagttgccccttgtcattagtcgtaccggttgcggcaaccggagcactatcaaaactgcctttataatccttaggcgatgcccaataattggctgtcacgttgtaaatggtgaaatcaacgccttgtaaaggcttagcaccatcgccggtccaaatttgatcagtcgcacgatcaatggcagtaacatctttgtcaaacccgtatttagtaaggacaacgttttgtgttgtcgtatcattcgtatctgcttgaacccgagtgccattaaacccgagaaccatcagtaatgtcattaggatcgtgctggttaatgtcagcactttcttggcaattgtctttttcattcttatctctcccacttattaattttttggttttttatgttaaaagcaagtactgtcgcgaagattatcaacccgagcactgaaagccaagctgcaactgtatcacccgtttgtggcaacaattgacgtattttctttggaacttttttgggggcatcggtgtgacgacttaccattttgttcttaggaaataaatcaatgcgtgattgattcccatgttgaaggttgcttgacatgacaaccacaagattctgactggcttcaatattcttaggtgccgccgtttctttaaaaagataaaccgcagcatgctgcccctgtcggagtggtaaatcgccaaagtacgcttctccctgaccagccgtcacaacctgtgcgataaggctggagctagcaggctgatagctatcttgactcaacgtcgtttgtgctacctcaatcgcaccgccatttttggagacaagctgccaaaagtcagcggtcacgtcataaactgtgaacgtcacaccgtttaacggcacatctgcctgcgaaaagtcgggttttgttgtcccgttatttgcttgttgagttggcaaggtatctttaaacaacagcttatgcaacacaacatcaacagtggtcggcacagttgccgcctgtgtctgctgcaacgttgtcgttgccaaactgactagtagtgccaagcaaaaggtcaaaatcactaacggacggaaggatttagtcatgttgcttcaccacccgtcgctttatcaaaacaaccagtaataaaaggaacgctgcgctgatcaatcccagtgcgataccaagcaatcgctgatagccctgaccacctgtatgcggcaaaattgcaagtggctgattaatcgcctgcaaagtgatcgtgctgccatcaatcgctaatgtgtatccgttcttactttcgcccggcttcaatgcctcaccgtcaatcgtgacggttgcctctttaccagtcgtagctacctgaatggcaatctttgcaggattgctttgatagccatctggtgcttttgtttctgacatcgtataggtaccatctgcaactaattttgtcgcaaacgcttgtccctcagatgtcgccgatgatgttatcgtctcagcttcgccagcacttggttgcagggtgaacgctgcacctgcaagatattggctttgattatcctgtttgatgacccgcaaagtcatggatggctttggttcatcatatttcgttagcgtcagaatttgctggtgatccccggtcaccgtaaaatcatctgacttatcaccaacaggattcaaagtctgctggccattaataacactccctgatgtcacattgtcctttgtgccatggtattgccattgcccatcagacgttagctgaaaaagatacgttgtcccatcaagttgataacctgtaggtgctgcagcttcctgaataccgtaataccctggcgctagtgcctgcagatccgttgacgtgatggcgttggttttggatgcctgctgaaaactgttatcgctgtactgggttaagttaaactgcatggccttcaactgatctgctgataaatcagtaccatcggttgtttttttctgaaactgaaaaccatactgctgatttgtcaaagtcaacgttgctgtttgctgatccatattttgagaactgataaacgaactcaaatcaattcccgaggcatcttcactcttaacgacatatgaaaaactttgaccctgattgttatacgcaggtgccgtaaagctagctttccagttatcagcttttttaaggactaaggtctgttgccaatttggatcaagcgaaccgtcagccacttttcgctgcaccgtgacgttgagcgtatccggtaacgattgattgcttaactggcgccattgcttctgcacataaactgtagttgctggtgccctgcctgaaggaatcccaaagtcaacagcggcagcgcccgcttttggtgtcaacaatgtttcaccattcatttggtaccaaaaatcaggcttgaagccagcatcctctgttttgatccgtacttgataatggatttgaacttcctgatcctgacccaagttcatgtgattcaccgtcaattgaccatcttggatcgccgcacttggcaactcacttgctggcacagtttgcttgccgacactcgtaacggtcgcctggttgttcgcatattgaaattgcgtaccaatcgggtctgtgatcgtgccgtcggtgacagtattaaagtttttgataatgtcctttgcctgattgttcaaataagcctcaacagcatcggcactatcagcatcttcgtataaatccggtgaattggtaataagctgcatgttttggcgtattttttctttcgtcatgtagtggtcgtcgtcagccagttggatgcctaacgcgtgcacctcattaccactatcctttgctatcttggcctcacccaatgttgctggccaagtatcatatatataatgacctgaactatcggtgtatggccatcgaagtcgtgcggtgttccctggttcatctctgctggatccaaaattagtgccatacaatgtaccatttatccactctgaatttatcacctcgttagaaaaagtcggcacgccatcagttaacaaaatcatcatttttttattgccactggtgtccgcattcagcatggctgatccttgccgcaaaccaatctgcgtatacgtacccccttgaaaccttggactcaatgcaccattaatcgcttgttgctggctggcattacctgctttgcctaatttgacactaatataacccgatttgccaccgatataaccaggactagaaaacccaattaaaccaacattgacgtaattacccagaccggcgttttgaatagaagtcaagaaattcttaacgccagtacgaacagcaccagctcgattcgtgccccatctgtttgactccattgacccagacatatcaacaactaagacaatatctacaggcttcacattttgctgtttattgcctttgacgttcaaataaacgtcgtacaatccaggggtattcgtctctttagcatattttcgaatctgataatccggattattggggtcaccaaatttcaggtaagagttcgtggtatcagtcgcatcaccattccatattgtattattatcccaccctgaaacttgatccccgccacgttgattgattacattttgttgtcccgtgacctgccacgaatttgtcggataggtaccattagcatcggtttgataggttgggcgaatgttatcagtggctgtcacaactgaactgccacttgtcactaagcctgttaacatactcatcaaaatcaataagaccgcgaacaaatgcccagttctcgccactttagctgtcatcttcgtaaattttaccctcctctcaagtaaaattttaaccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgctacaattcaggcccttcaggctgctggtgacaccgcgaccgtgattgcacagaagcttcatcgcagtaaagcgacaatctcacgagaaatcacgcgtggatctgtaactcagctcgactcgaagcgtcactcgcatcaagtctatcttgcggaaactgcccaagccatgcacgaccgtaaacgcgatagaaccggtcactacgcctttcttaagaccggccgtgcgttcttcaaggctctcgccagggagcttactcgtaagccgcgcgtacacagcgttgatagcttcgtacacttctatcgcgaccagggcaaggcttgcccttcaacgacaactgtgtatcgctacatcgacgccgggctgcttgcgctagacaacatgacacttcccaagaagctccgacgccgcatcaaaggctataagaacgcccacaagcgcaagaataagaagatatacggcgactcaatcgagttgcgtcctgcggccgtgaatgaccgcacaggcgtgggacattgggaaggcgacttggtcaaaggtattcgcttagctgatgagccagcattaatgacgctcacagaacggtacagccggactgagatcatcgtcaagattcctgactatcatgcggacacctgccttaaagccttgcaggacacgatcgacgactacggggccaaggaatttgagagtatcacttttgacaatggttccgagtttgccaagttatcagagattgttggaacccagatttacttcgcacatccgtactcgccttgggagcgtggcacaaacgagaacgccaatggactgcttagggaattcttcccgaaagggaagtccctcagagcagttaccctggttgaaattcaagcagtccaatccgcactgaaccatcgtcccagacgtattctgaactatcttcgcccatgcgattactaccgatgcatggcgtaacagcctagaccactatcaagaattcgttatcatcgttgcacttgacttgaaaattgaggaagtaaaattttaaacactgacagtgcaatcattcatgcgcttacaactcgaaagttttgagctatagactgcacaaataaaatatacatcaattaaattataattgatagtcaatataacaaattttcttccatttttagtttttgcctttgttatctacatcactttaaaaaaaagtaaaagagctcaaaactttcgagttacgatcacttgttaatccactttttacccaataattcttaaaaattcagattttacgctacaattaattaattcaatcaacactgtctgatttttagttcctaactagtggctgctttcaccagtcacttcttaggcatctgtgcgcctccttccattgtttccggcgtctctcttcttccaacaccagcttaacaagttgaccccgcgcaaaggaacgataatgttcgttatttaacaagatatttttaacagtgcatacttatttacattataggtattaatctgtacatataatgtaaaaagctatatttataggtaaataaggtcttcaaacccaaaagtagccttgaaacatccggcgtattgccagtaagtcccaagactacttataggttatttattcaactaattagtttaagctttgatgattttcccaactgcaattggtaaagtaacgtgggcatcgtagttcatgacagttccttgaacagtagccggtagcttcaaggtatccggcacaccatgaatataaatgacccttttatcgagctgcaaatcgtcactgccaaaagcggctttaaacgctgtctgcaattccttcagatcaacgagtttgtcataagcatagtgaccttctgcatcagccactgggtaactgtcatttggcacatgcatcttggccggttcagcgtcaaatggcaccatcgttgtaccggaaaccggttctgtttctggcagatcaacgaaaccgtcaccattagcatcttgtgccgctgtggcgatttctgctggcttaccatccgggaatccgtggaaatgttcccaatgctgcacattagaaggtgtatcaaacatatcgatatgaatcttcatttgcgcaccatcaatcgtgaatgtcgcggcaccgtgcggcgcggtgccaatcttctcagcgttcaatggcacaatttctgctttatacttttcagccatgcaaagcacttcttttagatttagactcagtttctgtatagtgctaactggaacgactcacaatctattgcatttcaaaagtgaggttgcaagattatttggccaattgcaataaccgttggcgcaaagcaggatcagctgcgtaaagataaagcccgtgcttcgccctcttcagcagaatattaatggcattcatgataatcgcggctttagcgtcggtggtgtcggccaaatccgggcgctttttgaatgcttccttgtcttggtactgcgccagatcaaccgtaagtcggtcttttgagggatcatagcctagactcggccctagaatcacacctgcgtaattcaagtcaaagccttgaatagtataaatggaaccaacttcatgcaatgtctcaggacgttgtgcccacgggcgatcggtgaagttgatcttgtcccaaggcaaccgcagagagccagcttggacataccaggttttaccatcgagcactgtgaatggatagtcagctgtagcgatcatgcgcgaaaggccggtttcggcattgcgccgctgaatgaggtcatacatcggctgaccatcagaaaaaacttgaaaatcaaaatgttgcggatgtggcaaaggcaacatttttccacgaacaaaatgatcaatccaatcattcaccgccgtatcgcctccccgcatctattcggtcagatgataatgtgtcactgcgtaatcgcgcgtcactcttttcaataaagcaggtgtccaaaaactctttagcttgactagctggtggaaatcgaacacgagcaccaccactcgagccaactgaagaatatcagcaagctgattatgcccacggaatttattatacggatcaggcgtcgtcagtagtaaatggccttcatcgatcagcacgacatctgcccgcttaccggctttgcggtacgcgttaataaatggtgttagtttcatggtagattgtaaaattaatccgaacagcgttcggattaattttacaatctaccatttactatgattattagtaactattttgcctctacccaaccgtgtgtcaataagctcgtttttttttcatcagcaagatcttgactgggaattgcaactgctaataagtactttggacgacttaatgctacatatgctagtttaagacaatcccgctgtaactgttctatttctggatccgatgaaaaatctggtcggtctcctagtaaataaggaaagatagttttgaagaacttattgattttgtcttcttcattaaacttcatgtgtacacatgaagttagtaaaagcagtgtcgatcgatgtgtttcacctttaactccgtgaattgttgcaaattctcggtggactgtcgataaattcattctttcaggttcaccttctaggttgctaacgtcttgaagcagatgcttgcattctctttgcaaataagcttctgaaatagtttctgaaccaattagactgtacaaatgatattgtacctcgttcaatgaaatattttgttttgcgagtttctggatgacatctgctaattcaaggttgctatcatgattattacggattagtactgattcttccataaaagaaacgccattcgcattggccaataatttgataaccaatgcataaatttcactgacacttctttcatgagctcgttgctctgaaccttctttggaatatttgggttcaacttttataatgtcactgtgcattattccgacaatagcatctggtttctgcaatatacgaaaatttggatttgaactggcagcgtcttcgatcagccgagtatgcttttccttgagttcgtctccagtttcatatgtcataaaatacttcggaaagaaatttagttcttgattcgaatggaattgttcatattcctgaacacaaacatgtttaactacagcagcaattaaactgccaaaccttgtagtttcagagatttctttagtctggtagaattcgttatcgggtctcgggttccaagagtcctctgtctcggatccatagatagtatataatgcttgatacggatctccaaatctttgtacattcaactgtttgccattagccagaccatttataatggcaaactgaatccaatcggtatcttgagcttcatcgatcattaagtatgaaaatcgtttctcaaatgccacgctcaactcgtctctatgtttacttagataccaataagacaatgatttgagatcagaatatgaaacatagccatcccttaacagccattcgcatgcacgattaatggcatattgacaacgctgattctggtgtctgttagtgtaataaaatgatccgtcatctaaaattactagcttgcacccatttttggacggcttaggtacgttccaatctgaacgatagtccttaacaattctcctaaaatttttatcatacttttcatagaacttttcatcatctaaaagcttaagcgtcacaccgggtaggaccgtggcaaatgcagttttacctaaaaatttatccatgaaactttgaatagttcctacaaaatttggatattcaatttcatccacaccagcaagcttcaaccgtgctaaaatctcttttacagcaacattggtatgtgtaatacagcagatgcctttatcttcgtagttgcgagtggtcaataaccttaacaccttcgctgctaatacggttgttttacctgatccaggtccagctacgacgtcaattcgtcctattgcttgaataacttctcgctgttccgctgtaaaatgcgcaccgtgcaacaatatgctttcaatttgcatcaagttcaatcttgttcaacctcctgcccacttgcaaacttaatcgcattaattaaatacttgcattcttcattttgtgaatgtgttgtatcgccaataattttatttttcagctcttccttttcatcttgactaagacccataattagttttgctaattgttcactaacctgtgtttttgaaaccgagcctttgttcaaggctgcatacgcattgtatgcagccttattcggacttgttttataatcttcttcaaattttttaataagtttttcccgatgattttctctaacgaattgtgtttcagctatcgcttgaatcgtaagatgacgcaaagagctacgcaaaagactgtactccaaagtccataatggcgacatgaatactttactattggaactaaattcttcgtatttttgattgagacactcttgcctttctgctgtcttactggcccagtcagaatcagatcggaatttttttacttgaataattaaattcttaattttagtattttcaaatcttagtttaaaagcagctactaattcagcaaaagtcgcatactcctctccgaacaagtcaacattcaaatcgctagggccactaatcaactcctggattttttcagcgctctctgaatcgataccatacacagtcggattaatatctgaatctgtaattatagagatagggataccaattttttctgatttttctttttgagaaaacagtttaatatattgattaaagcttgtcccgccaacgtttacaattgagataccagaacgatgtaacggtaaatttattaaatctgccagggctggtaataaaatattttccgcatatccctccaccaaaataattccttttgcaaagaataggttactctttgttgcatctaaaaatcgattcaaaaaatcataatcagcttcctcaagcatggtgtcctcaggtgccatcgaataggctttattagcgttcatatatatcagcgatctttgatctatcgatgcggtcagtgcaacactatgtgaagtcaatataaactgctgagatgaattatcctctgtgctaagaatatagcgctcgatgtatttaattagtcgtatctgagcctgcacgtgcaagtgcgcctctaattcctctataagcataatgtttggaccataaaccactgaacttgaatgatcctttagcagcgctaactcggtcgaaatgtacaacaggttcaagttccccaatcccaaattgacgctttctgaacttaaacttagctgtttgaatatttgatcaagtgtaacttgtgttagttgaaagcgcgtgtcacttttatcctgatcttgactatcaaataactgcctcaataccgaatgaagttctttattaattgattgtttttccaaattattatcagaaagatgatcgttatctttaggtggattcgattcacttggaaagccatctgagagatatccctctattattgcgttggcttcctccaacgcttggacaagttttaatttatgttctgggtgatttcgaaactccgagtgtgctgcaagtaattgtggcagatgtgagcgaaagccaggagttaattcatctgttgcatttctcagagcttttaagtatgtaacacgtaagtatactcgtgccccacttgctaacgaagattctgcaccttcatctcctgcaactagatttcgatctaaatattgacgtccagcttcactcgttttgcgctcaactgttagttttacatgtaactcatattcattattatcgtcaaacgacagccactctagaaaagttccagcctcgtacttgttgagactacaaaatacagcctcaatcttaaaatcatttgaaaactcggtcccgtcaaaatagaaatcctcgtcttgaatactggttcgatcatcgctaactgttccaagcaacactttaattgcatcgataactgcagttttccctgaatcattttcaccgacaatgatattcaagcccggatgaaattttactatcaatccaggttccccattcacctgagaaacaaattttcgaaaatcatacagtttaacagtttttagaaacactatacattcctccctagggacattctactatcccactcattatgcaaaaatacgactaaatgctcgaaaaattcgcttataaccagatgacctacacactaagtagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaagtatacaactagcgtatgttgacacatgtataaagtgattccaaattcaaacaaatcaacaaattggtacgttgaacaattaatcaataattgggtattgggttctctacatgattagaccattaaagagcaattccatattatggatgtaagctgattcctgagacaacttttaagagagggtataatgaataaatcgtctctcaaaaggaaggaatttttacatgccaactcgttacgacaaagaattcaaaaaaaacattatcaacctatataagcaaggcgaatcagctgcccaactggccagagaatatggcattggctattcaacagttcataagtggatccagggccaggacaaaactcaatccggtaaatcgccagacgaaatcaaagcgatggaaaagcgactggcttcgctgtctgaggagaacgaaatcctaaaaaaagccctggacttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcggacttgaaacaacggattatgcggatctttgcggaatttaagcagcgatacggtgttatgaagatccaccatgaattgaatctggaacttcaaccactgcagcttcggtgcagtccacgacggatttcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgctacttatcaaccatcatggacctgcactcacgacggattatcggctattcgttctcaaaaaagatggctactgatttagtcttaaagacccttgaaagcgcggttaaaaatcgaaccattactggggacctgattatccatacggatttaggatcacagtataccagcgataattacaatcaacgtttaactgaactacatatccgccactcatacagccgtaagggttgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctactagacccccttacaagttgaaattgcaacacttacgagccaaatggccgcctgatttaatgctttccagggttcaaataagttattaatcgcgattaatgatttatttgagctgtggaaggtaaacgcggttctgaatgtctcttaaaatctgtctcaaatattgacttcaatccagtccggctgcaatagttttaggaaacaaagagtttccatttttgttcgtttcaaatagtttattaagagggaaaagattagctgtttaaaaaagtgggtttgcaaaaaagaccattttaattgaagtgcaatagaaaagttagacaatttagattttgaattaagcaatcatggcttgttcccggtactcaactggggtcaagccatttttgtttctcgaaattctgacattgttaaaccaatccacgtaaccgttcaccagcttgcgcagatctgagagcgtgttgatctgataccgattcaagcactcacgttttaggaggttgaagaagctttcgatgggcgcattatcgtgacagttacctttacgagacatgctctgtataatgttcatagccttgagacattgctggtagtccaccatttgatattgccacccttgatcagagtgaagagttggtttgatgccttctttaaggtgatgctctaattcatcaagtgacgcttgaatcaaagccttattgggagaagcactgacaatagccgcgatcacttcacggctggcttcatctgtgattgacgagatatagccccactcgccgttgtacagccgtacctgggtcacatcggtatggaacactgtgagtggctgtgtggtttcaaacttctgattcaagatgttaggtgcaatgagaccaacgtgacctttgtaggagtgatatttggaagtatgtttagagtaaatcacacatttcaatcccatatcactcattaggcgtctaattgtttcctcggcatagtggaagccgactttgtctgcttcatcgtgaattcgacgatacccataagtctctttcgaaccgaaaaaacacttcttgatgaaggctttgacctcggcatacttatcaggcttcttatcacgcctaagccgatcgtaataagtcgctcgaggtaagtggagggacttaagcagctcattgagatcgtattgcgaccttaacgaagtcacgatgccagcctttactttcgtagagagtgcttcggtgaattcttcgtcagagtcgcgagtgcttttaaaatatcacggtccaattcagcttcgtgcagcttgcttttaagctccagaatttcttacttatacttctcctcttgcgttggctcgagcttcttgattggtttgatttgcttgtgcttacccataggcggtcttcctttacgctgcgcacgtaaaccggtaactccttggtcctttacgatacgaatccaactgagagttgacttggctgggagagataccgaaatgcgcggcagctcgaactctgcttacttgatgtgtatgcacatactctaccacagtaattttaaaggtctgcgaatacgtagtcttgttgtgtttgaccttcaaagactcgataccgtgcgtcctagcttgattgacccaggttcgaatattagcgcgcgaaggaataccatatcgaacgctgagctctctgtaaccaataccgcctttcaagtattcagaaaccacttttgcctttaattcgttactatatttggtcacaagaaatgccccacaatcgttagacttcttgtctaataattgtagggcacttcaaatcggctgatcgaggactttttggtattcgtccagcacgtcattcggcaagggcgtcagtaaatgcaggtcatcgatgacatcgctggccgtgtcggtgctgggcaaatcaacgaaaaggtcgattttactgagacaatcacttagtagatcggtcagctgcgaaagcggcttgccgttttcatcggtgatcacgacctggcgatgattgaggggctggtgctcgatctgaatcattttcagcgcatgataaacattcaactggctcacctcgatatggttaccccgattgtaggcaatctggcccgaaaaaacaatctttaatcatgctctggcgcggcctggcgctctggggctaccggcgggcgatgccaacgcagccacagttctttgattccagacaaaatgagggtcggtagcgccgggatgaagactaccgcagcatacagcgtgctagaaagtggcgcggtccccatcacttcgttgaagaacggcatgatggtgacaagtaatgaagccaccgccgcgaaagccactgccagcagcaactgatggttttcaaacgggttgcgggcgaacaaagtgcgggtgctacgcgcgtcgaacacatgccacagctggccaaacaccagggtcaaaaaggcgagggtttgcgcttctgcgccgctcatgccttgactggcagcccagatgaaggcgacatacacgagcccacccatcacaatgccgcgcaggaagatgcgcccgagcatgccatgcaaaatggattgtttcacattgcgcggcggctggttcatgaggtcggcttctggcacatcatagccgagggcaaagctcggtaaagcatcggaaatcatgttcacccacagcaccatcagcgccgttaatgttggggtggtggccgccacttggccgacgggttgcgtcatcagtagcacgccgaacagcagcgccaacacctcggcgacattggtggttaactcatgccgcataaagtttttgatattgccaaaaatggtgcggccggcgcggacactgcgctcgatggtggtgaatttatcatccagtaaaatcagatctgcggcgtctttggtgacttcggtgccattaatgcccatggcaatgccaatgtcagcagcgcgtaaggctggcgcgtcattgatgccatcaccagtcatggccacggtttcgccatgccgctgcaaggcgcgcacgatgcgctgcttgtgttccggcgacacccgggcatatacgcggatgcttggcgcgagccggaacaaatcttcatcggtcatggcttccagctgcttgccttccactacccgggcgctagggtcggtgacaatgcccagctttaaggcaatcgcgcgggcggtgactgcgtgatcgccggtgatcatcacgacctgaataccggcttggtgcaaggtggtcacactttggcgcacttccggccgcggcgggtcaatgatgccggcaatgcctagtaaggtcaggtgctgctcaagctcagcggtgctaccatgcaacgccaggtcctcgtcgatgtcacgcagcgtcaccgccagcgtccgcagcgcctgttcggcaaagcggttgacctgcgcttctaccgcagtttgaccagctggcaatgttacgagttggtcgtggtccagaatggcatcagttttggctaaaatcacgtctggcgcacctttagtcagcacctgatactggtcgccatctttaatgacgacactcatcattttacggtcgctgtcaaacggcagttcgcgaatgatgtcgatgtccagcgcctggtctttgctcaaaatcgtatcgcgatcgataccaaatttgtggcccatcactaccagcgctacgtcggtggggttgccatacgggcggctgcggccttcgtcgtcggtttgaatcgccgcttcgttattcaggacagcggccatcatgaagcgcgaaaatccgggggtgtcggcttcgtcatcagggatgatttcgcctactggttcatagccgtcgccttccaccacataactggcgccattggcataaaaccgggtgacagtcatttcatttttggtcaaggtaccagttttatctgaggcaatgtagctggtggcccctagggtttccacactgttcagggacttgatcagaccgttgtttttggccagcatcgtggccccaatcgtgagcacaattgacagcaccgccggtagcgcatcgggaatcgcggccaccgccaaggcaatcgccgtagagagggattcggccagcgcagcgaaggagagactgccagtttgctgataggctttcaagagctccaccagcaacgtgaacgccacaatcaccatcgccaccatcatcagtttggtggtcaggcgcgcaatggtgcgttcaatcggggtctttttgtccttgacttgatccagcaaggtggcgattttgcccagctcggtttgcatgccggtcgcaaccaccaccccgaggccgttaccatgcgtcactgtcgcaccagaaaagcccatgttggtgcggtcaccgatttgcacgtcagcgcccaatgcgtgggtttgtttttgcacaggttccgcttcgccggtgaggtgggcttcgttggtttgcagctcggcgacatggagccagcgaacgtcggcttcgatgaagtcgccggttttgacactgacaatatcgccaggcaccagctcggtggctggcaccgtcagccagtcgccatcgcgcaggaccttggcgtggtgatccgccatcaccttcagggcgtccagggatttttgtgcgcttttggcttgccagaaggagaggccggcattaacgaaaatcagcagcagaatcgcaatgctttcatacactgccgccataccatggctggggtcgtggcgcacgaagaagtcatagccggcgctggcccaggccaatagcacggcgatgaataaaataatcaccaagggttctttcaaggtggccaaaaactggcgccaggctggtaggggcttgctggcggccaaggcgttggggccatgctgggtgagccgggcctgtgcttcttcactggtgaggccgctttgccggctggtggccaagcgctttaggacatctgctttgtgttcgttgtaaggggtcataagtttcctccaataagaaaaggccgcacccaagaatcgctttcctccccgagaaagctttcttgagcaccgcccaaccgaattttttgaattagttaccttttattactagtttaaaggatacctaatgttgctgtcaaaagatttggcccgggccgccggtggcgtgggcggtgggctccgcttggggcgcgcggcctgctgtgcggccggtccgagccacagtacggtctcgggcctaattttagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcacactgtctaccgctattacgatatgtggcgagataaaccagacccgacagctgattcgctattagaaaggcttttaaaaaaactgttgcttcctatcgctttgcatagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaatggtttaccacaagccattctcgtgacacgagctaatgtatcagatcgttcaggtgcattggctatgtttagtttggctagccaaaatttagagctggttcagcatgtcatggttgatggtggctacactggcaatgactttgcggatcaggtgaagctcattttgaatgctaagacgacggtagctaaacgcaacgagttgcatatgttcacggtgttaccgcaacgatggatcgttgaacgttcatggagttggctagacaaatgtcggcgactttggaaaaactgtgaacgtgcccttaacggcagtcttcaaatggttgtattggccttcctgaagatagttctcaaaagatactagacaggttcttagtagtttacatgacgagccgcatgtttgagtagtaatggtgctaataacgttgttaggataatggcagtgataattgccgaatagtaatcatcactgattagtttggattggtagcctatttgagcgataatcaaggccatttccccacgcgagaccatccccgcaccaacgaggtaagcttcattcgaactgaatccggcccatttagccccacttcccgctcctaatagttttgtcagtgttgccacaatcgtcaatacgataattaataacaaatcgtgttctatgccagctagtgacatatttaaaccaattgaaacgaagaatacaggaatgaaaatcgcataaccgattggttcgatactttgatcaacttcatgagctacatgagtttgtgcaatcgcaattcctgcaaaaaaggccccaattactgcactcagtccaatcagatctgcaatatatgccataccaaaacacaaaatcatcgccattatagtaggtcccactggattcaataatttggtgcctagtctagcgaggagaggggcgataaaacgcatcacgaaataaattgcggcaaagtaaattagctgctctaaaaaagtcagagctagcggtatctgggtatccgtaccagcctttgtacctattaaactgaccataatgctaagtaaaacgacagctagcacatcgtcaaccaccgcggcaccgaggactgttgaaccgctcttactatcaagtaaatttagttctttcatgacagcaactgaaattgaaaccgacgttgcggcaaaaataacgctcaaaaacaagctttcaaattgtgtcaagccaaaaacaataccaactggatagatcagtaccatcggaatcaaaactcctaacaacgcgacaattatgctaggacgcaaatattttttaagcaatgtaagatcactctcaagtccggcgataaacattaagatgataaccccaatctctgaaaaaatatggatgaaatcattggcgtgaacccaattcaacaacgcaggaccaagaataattccaacaaataattgaccgatcactgctgggataccaaccctagaggctagatggccaaatagactagttgcaatcaagatgatcaccaaggtacctaaaaattccaaacaaaaacctcctcatacaaaaaacgtaaacccagatacctcttacacacccctgaaagagaacaccttgagcttacgtcaaccgatttatttattcatattttaataatacttcttatatgctagcaaactaatcaaaaatattcaagtaacgataagttgtcacatttagttacttattcgaaacacagacaccgccaactttaaaagtgatttctgaattttctttacctattttaaatatctggatcgttttctccagctataaatcatgctggatacataaccgagctaaaaagacaccgtaggtatattatcaggtccaaggaatccaaactagcagcgaccaaaacatcattgatttcttgtttgaggctggtgtaattcttcttttctatgatgaaccttaaaaggatctggtgcaaacagtctgagagatgaccatctaaccagctattgatcctatgttgaaggttatgcagctaacaatgcttctaagaacctgtctagtatcttttaagaactatcttcaggaaggccaatacaaccatttgaagactgccgttaagggcacgttcacagtttttccaaagtcgccgacatttgtctagccaactccatgaacgttcaacgatccatcgttgcggtaacaccgtgaacatatgcaactcgttgcgtttagctaccgtcgtcttagcattcaaaatgagcttcacctgatccgcaaagtcattgccagtgtagccaccatcaaccatgacatgctgaaccagctctaaattttggctagccaaactaaacatagccaatgcacctgaacgatccgatacattagctcgtgtcacgagaatggcttgtggtaaaccattaatatcaaccgccatatgacgcttaatccctgaaatctttttgccgccatcgtagccactatttttcgttaaatcagtggttttaacactttgagcatcaacaatcacaaacgacgttcgggccgatcggccctgtgcaaaacgataggaagcgacagtttttttaaaagcctttctaatagcgaatcagctgtcgggtctggtttatctcgccacatatcgtaatagcggtagacggtatgccattccgggaaatcgtgcggtaattcacgccattgacaccctgtagtaagcgagtaaaggatggcattgaatacgtcataaagatcataacgacgcggtcttgtatgcttacggaagttttctaaatcaggttgtattaacgcaaattgcgctcgagaaatattgcttggataatctggcatgacaaactcctcagtcggttttccacaattctaccagattcagcagatactagacaggttctaactcgtccacgactgagaacccgatgagacttaactctcgtagggttcttttgcgtattgcgtgaacaatttccacaccgctcaacgttgcactagcggttcgaatgctttgaaagcttgctgagcggacacgatgacgtttaatgaatcggtggtcctgttcaatcaaattatttcgatatttggaacattggtgggctgatttgctcaaatagtcttgctttatcaggtgcttcactgctttcagtgttgcccgatattgatcagtgactaatcgatcaggccgaccattggtcgtcaagagacgcttcaaaaagtgataggatgcggtataatcgcggtgttttcgtagctcaaaatccatggtcaaaccgttactgtcaatagcgcgatacaaataggcccaacggcctttaactcgaatataggtctcatcgattcgccaacttttagcgtgagctgtttgatgccgacgccatagagccttaaagatggggccatagtgatgaacccaacgcatgaccgtggtgtgatgaacagtgataccccgatcccgaagcaattcaacgatgtcacgatagctgagactgaatctgaaatagtagccaacggctactaagatgatgtccttttgaaagtggcgtcccttaaagtgattcatgcgcgcaatccctcgtttcttggcacccagtatactaaaatcaagtcagcgaggaaaatttgcaccagaaccgtggctttaatcacacgggaaaacaggtgtaaacagtttgccatttcggtatatcgtgaggtagctgataccatttagagtcaatacgaaactctaaaaggccatcaaagatgccgagtaaattaacttttcaaggacataatttcttacgaaatggttctagatcaatgtgaattaattcaaactgagaacggatgatgagacaaaaatcattcattttttaatagacttgatctaaaagctaagttattttccaagatatcaaacaacttcttaacccaagaatcttccacacataggacaataatgaatccaaatagattcagctttttcctgcaaaccgggatcagtataaacgtccagtaccggataatcacgcattaagttcagctgccaatgggtatcatctaaattaaaaagatccgatttagtgtctccccttactacattatggcaatacacacaactgttgttatacatgcttccttgctttttgattttaaactcctccattttgcatattataagaagattacttctacttgatatatagatgctttccttgcgagggtaagtcagacaaggaagcatttctaacttgagatacttaagcttgtctcaatagatgtagatagcggctccccaatcggatattaacagctcaactagtcaaaccagatatataaatgtgacacaagctggaatatatatcattatctagataattcaaattaagctaataaaatcaataaagaaaattttaaataacattattttataaacccctttaggattttcccgatttgatattctacgtatgttcgtttagttgcgtcagttaaaattactaaactgtcaccttcatgaatcaaggaatcaccgtgtggaatcacttcctgttcgccacgccggattccgattagtaatgcttctttaggccatggcatatcgcggaccattttgccattcaagggactgccgaagaaaaccggtatttccagtcggtcgggtcgatgaagctgttgaactgttttcggcattgtcatttgctcgagtaacgcttcatagatcggcgcaccgccaagcaaatcaaccacgagataagcagttaacgataggaccgctaacggcatcaaatgcgtcaaattaccaaccatctccgttaccaatagaatcgcagtaaacggtgctttcccaatgccagcaaagtaaccggccattgaaaaaatgattaagttcatgatataaacgtgcggcaataagccgagttgattcatgaagacgccataaatggcaccaatcacggcacccaaagaaagaatcggcagaaaaatgacacctggtaatccagaaccatatgaaatcattgaaaaaacgaaacgtacaacaaaaattgcgatcaatacaagcaaagatggcacatactggccaaaaccgacaatcaaaccattgccaccaccaagtaagtttggtgcaaaatagccaaccagaatcaccagcagaaacggtacaatgccttgtaatggccgcggtaaatgtgtcaagttgcgataccaccgcggcatcaccaacaagattcgctggtataagtacccaaacaagcccaaaagaatgcctagcaaaattaaatgccaataactcgatacaggtaaactacgcgaatagcttaaatgcagcaccggaacaagtccgaaaacattcagtgaaacaaaatccgatccaattgccccagccaatgccgttaaccaaacaagcggtgagaaattatggtaaacctcttctaagacaaacaaggtcccagcaatgggtgcattaaatgctgccgccaagccagcagcagaaccggatgcaattaacaatctccgatcagttcctgatagcttgaatctagcagctaaaccttgcccgactgaagcgcctaactgaatcgacggtccttcccgtccgagaaacaacccaggccccagcgccagaacaccgccgacaaattttcgccagaggatcgaccaccagtgcatctccaattcaccagccaactggccttcaacttgcggaatcccagagccagaaatatagggctctttcttgagaagccacgccacgatcaacgccaaaccaagattgacaccgatcaacaacgcccattgccaccagacaaacggtgctattcgcaagtgcccatataccagccgactatagcgcagccctacctcaatacaatagcgaaacgcgctgacaacagtgccgctcattaaaccaacaagtagtccgagtagcacagatcgtaggcgagtaaggttaaatttttcttttacaaactgtgtcagatatctcatctcccagtataccttctacttaatatagaactgagattgtaaaatctaagttactaaacataagatgttccaaactccggtcttttttagaaactgtctagtatcccttaagatggttttaaataagcaaattagttggataccattattacactcctatatttaggatcaaaaattcctaaaacattaagaaaacatatttgtttccaacgaaagaagtagtaagccctacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttcttaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggtaattttcatgatgttaatcctcctcgggtgcagcgacagcttttgcgcgcatcttgcttaactttgccggattgagcgttagtgctgcaatgaaggcaaccccagctgtaaagactaagaacaaaaatgctgtagcgtacgagcctccggaaatttgaaccaaaataccgatgatgatgggggcaagaaaaccggatagttggccgccgaagttaacgatgccaacactggagccataagcttttttactgacaagttccgcaaatagtgcaaaagtaccagcaaaagcaatggatttgcagaaataggttaagatttcaaagatgatgactgccggcaatgcagtagatttgtacatcccgaacatcaatcctgttgccagcaagcttgcaacgccaataaacaatttctctttacctttgaaaaaccgggccatgatgtatcccgaaatcaatgagccggcacctgcagctagggacggtaggggtacgagccaagaaataccggctaaattaatatgacgtgctgctaataagtaagtcggcatccaggaatcaagcccctttgtgacagagctgaggccaaagacgatcaggaagaattgccataatacaccattggttaaaacggttttccatgggacgcgtttttgtgtcgcgtggcctgatgcttttaacctcgcttgctttcttggacgcagaatgatggcataaacaacgatgaagacgataccgagtaagcccattaggtggaaagcagtacgccagccagcatatgcaatgaccggggcgatcacaacaggcgcaatcgctgcaccaacataattcgatgaaattgtggctgaagtggcagaggctcttttgttgtagggcatggtttcgctaatctgtttaagactggcagaaggataggtaccttcgcctatgccaaaaagtatccgaatgataatcagggaagctaatgaccatgcaaagccagttaggatggtgaagagggaccacatggtgattgcaacgataatggtgcgataagtgccgaatttatcagtcaaccaacctcctggaatctgcatgaatgcatatgagaagaagaaggcactagcgacaacgccgagggttgctgtacttaagtgaagatcttgaccaatgtaagatagcgcaatactgatagcggaacggtcgatgaaacaaataatatagccgatatagaccatgatgaaggtaatggttccacgatgcgtctttactgctgattgcgtatattccattcagtttcctcttttctcgtaagtggtaattagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaattagtgactcaatgaagtgaatactactgaaaaaagcctcctcggtaatattctcgttagctgcgtggttgttttgatcaaaatttgccagtggaacggtgaatactggtactcgaagaatatctgtccacacataattgggatcggttccgggcatcaccggttcaatgacaagtctgacctgtgaggcctgggccgcgtccttgaagtttgttaagtcaacgttacttgggtggacaacggttggcggtactttgccggtgatggcatatgtcagttttcctgttttcaaaaaggaagccagaatcttttcgatgcctgcttggatcacaggaatactttgggttccgacgagacgcatatcaatgctgacaaaggctgaaccaggaatgactgtcttgacatctgttcccgtgttgccagcggccatgccgttaatattgaaggttggttcatacatcaattttcgataataagtttgtttatcagtagtggtcagttgactatcaaaaacggtggtaattttctcggggtcgaatggtaaagcgtctatccacgaaagctcttggtcggtaggtgcgttgacgccctcgtaaaatcctggaattaatacgtgttgatgcgcgaaatcatatagctggttcaatgcttcatggagcacattgactgggttggcgatcacattacctgcgttaccagaatgattcgcgtgcgtcgcggtggttgaagtcaagcgtaaaccgaacaacccgcgatttcctaggcgcaaaacatgagcaccactggcattcatcgagccatccgtaacaaagacctttttgacgttgcgcagtagctcatttttttgactgcggacgagttccggcaaattaacgctgccttgctcttcctcgccttcaatcaagaattgaatggtgtaaggtaacttgggctgtttagcaagaaagttgctgatgccagttaatgtcgcgataagttggcctttgttgtctccggttccgcggccaaagaaacgattgtcccgtttggttaaagtgaaaggatcacttttccacgcggctaaattaccgggcgtcatgacgtcataatggccataaaagagtaatgcttctggccgttctccagcaactgttgcaaagatggccggtttacccgcggtgggaatcaaggttacttctgcaccgatgtttttttctaatatgtttacaattttttgcctagctgcatgttggtcttcatcgttagtgctgacgctgcgacaagcaattagttcttgtagcgcgttaactggcgaaatgataggttgcatgtcggtcgcctcctaaataagaacttaatgacgtcatcttattgcattctcatttaaaatggaaatacaatattagtcatacaccataacagttttgatataggaggtcggtaatatgcggttactgcaacttaattattttctcaatgtcgccgtcacgcagaacatctcaaggtcggcacgaacgctaaatgtgagtcaacccagcctaagccgcagtattcatgaattagaagccgagctcggtgtgccattgttcacccgtaacgggcattcgctagcactcaacgaagccggtcgccgttttgctgttcaagttcgagctggtttgaatgaggtgaatcatgccgtaagagacttacaccgattcagcgaaatcaattcaaatcaagtgacgttgcggtttgaaagttcgaccgccgttttacctggcctgctcggaaaacttgatgcaaaactgccaacggtcaagattcacctcatgcaaaatggtttcgaacaggatcgtttaagtcactacgattttgaatttacaacaaagccaatttttaatttttaataatcgtaattttcatcttttaaaagaagaaatcttagtgcggtttcccaagacgtatgacaatgcaaacaacaaagaggtgcgcccagaagagttagtcaagtggccgttaatcttgacggaatcgaacccgttacgtgaacagatgacttctatgctgcaccaagcaggggtaacggttcgtcctagttttgtgactggcgatcggcaaacgattcttggccttgttcgcaccggccaaggtatttgtttcatgccgcaatattcatgggctggcacggatgtttcagggacggtcggctatcactttgcaccggaacgggtatttcgtgatatttacttgagtgcaagcgaggccacgatgagactgccttatcggagggagattgcagagacgattcaacaatattttgccgatttagtcgcaggttgatgatctggcctttcccattaaagtttccagaatttcacgaatgcctgcagaaagcaatcaggttaatttaccaagaaaaaacgatggctgtctttgatgtcatctttttttatgtacaaatgttgttggaattatcccgaagaaatatctgtgataaatgcccatttaacaatgaattttggatacgagtgcaaactctaggtgattttttaactgaatgaataaccacaaaaaaacaacataacgacattttttagcaacaaagcgttacctttatgagctggtttgcccgtattatgaaagcgcaaataaaaatagcgagttaaccggtacttgcatgcaaaacgtatttattaggaggagcaacatgacaacagcaaaattgtgggaacaacctgaactaaccgatatcaatcggatggttcctcgtagccattttcagacattcttcccaggcgaggatagtcagccgcggaattatcagttattaaatgggacttggcagtttaagttcttggatgcgccggaatatgcgccggaaaatttcatgaacagcgactttgatgatcaggattgggatcaaattcctgtacctagcaattggcagctgcaaggttatggcaagatgcattattctgatctgtggtataacttcccaatcaatccgccctttgtaccgagtgaaaatccaactgggttgtatcggcgaacctttacggtggatgaggtagttgataacgaacaatacatcattggcttcgatggggcagattcggcttttaagttgtaccttaacggcgagtttatcggctatagcaaaggtgcccgtttgccaagtgagtttgatgtcacgcaggcattaaaacaaggtgttaatacaattgccgttgaagtggttcaatggtctgatggtacgtatcttgaagaccaggatatgtggtggttgagcggcttgttccgtgatgtgagtttgtattcgcgaccacaaaacgggttatatgatgtgcaggtacgaacctatttattgaaggattatcgtgcgggtgaactagtcgtcacaccgatagtatccgggacggagccgttaaagattcattatgaactagccaaagacggggctaaattgattgaccaagttctttctgccgatgcttctttggatgtcacgctggacgacattcaggcgtggtctgctgaagcgcctaatctttatgatttaacgatgacagtgttgcaagataatgagccgcttgaagtggttcgtcagcgggtcgggttccgccaaattgagttgaatggcaagacgttcttggtcaatggcaaagcaatcaagtttaaaggcgtcaacatgcatgattacagcgctaccaagggccgagtgatgacgcggaatgattttgttaagaacatcagcctgatgaaacaaaacaatatcaatgcgattcgaacgtctcactaccctaaagcaccgtatttctacgacctgtgcgatgaacttggtatgtatgtcattgatgaaacagatttggaatgtcacggctttgagttgactgaacgctatgattggattaccgatgatccacgctggaagactgcatatgtagatcggatgcggcggactttgcaacgcgataagaatcatccttccattatcatttggtcgttaggcaatgaatcagactttggcgataattttcgggcgatggctgcatattgtaagcgagaggatccaacgcgactcgtccattacgaaggtgattttgaagctgaagtcagcgacgtttattcaacaatgtacacgtggttggaacacgatactaagatgacaatggcagatgtattacgtaagacgcagaagccccatatcttatgcgaatatgcacactctatgggcaatgggcctggcaacttgaaggaataccaggatctcttttacggacatgaacaactgcaaggtggattcatctgggaatggtttgatcaaggggtagcatcgcaaaaggatggtcaaacctactatcgttatggtggtgactttggcgatcagcccaataacggaaacttttgtatagatgggttgatccgcccagatggcaatccgtctacggctttaaccgaggtcaagaagacgtttgaaccgttccagatccttgttcgtgatctgccaacgcaaacggttacggtgattaatcgactggactttctaaattctgattactttgattttggttatgaacttgaagcaaatggtcaagtgattgctgatggcaagcttgatatcccaactattttgccaggtcaccaacagaccgtgaaacttaatctcgatttgccggagtttgaccctagtgtcatttataaccttcatttggttacgcatctcaaaaacaagactgcttgggcgaatgctggaacagtgctttctcaatctgtcatgaccttgcaacggccaaaacaccaattgaaccatcagacaatcgtggcactacaagcaagtgaaaataaaacgacaatcgaaatcaaaggcggtgcgaatgcataccggtttgacaagattaaaggtaccttcacattgacacatgatggtcgtgtcctgattcatgatggcatcaaaatgaatttctggcgcgcccctatcgacaacgacatgtatctgttagatgactattacaacaaatatttcctgaacctatggcatgaaagtacccgcgaagtccaattacagccgcaaaccaacggcgattatgtcgttaatctagtcaagcaagtgggcacgaccaatagtggctggtattaccaaatcacacaacgctacacattacatcaggatggaagttttgatcttgatgtgattggtaaggcaagtggcaaacgtgacatggcaccagagatgctaccgcgaattggggtaaagatgacgttgccaaaagatttccagcaagttgcctatgacggactgggaccaactgaaaactatagtgactctcatcaagctgcctactacagtcattttacgagtcgggttgatgacctctttgtcaattatgtaaaaccgcaagaaaatggtaatcatatggacactgatcgattagcactgatgaacggtcaggatcaattaaccttgacgatgatgaagccattgaacttcagtgtgtcaaactatgcggacgaaactttggaggccgcaaaacacaccattgatttgaagaaatcagatgagctcaatctatatcttgatttccggcaaaacggacttggcacgaactcgtgcggccaaaatcaattaaagcgtcatcgctgcaagtttgatgattttgaacttggatttaacttcaagatcaactagtggaggagtttcaaggaaggaagtgttctacgatgtcagaggataaatcgcgacaacgactggggtctgccgcattgatgttaatgacattctcggcggtgtttgcttttccaagtatcgtcaacaatagtattcaaattggattggcaacgattccgggctacatcttcgggagtctcttttactttttgccgtttattttaatgattgccgagtttgcatcggctaactccgacaaagaatcaggagttcatagctggctggaaagtgtgttgggaagtaagtttgcctttctgggcgcttggtcatactttttcgttaacttgttcttctttgtttcattgttaccaaacacattaatttatggttcgtatgctttgctcggccataatgtgtttggtggcgcgatgggtaccaagattatctcggttctctcgatcgtgttattttggttggcgacctgggtctgcatcaaaggggtctcttggatctcaactgtgacgaattttgctggtactgcgcgacttctaatgggggttatcttcgttgtccttgcctttatcgttgtgatggggatgggtgaaaaaccagcacaagattttagcatgaaggcaatcacgcctacctttaactggacattcttcatgacaatggcgtggatattacaagctgttgggggtggcgaaagtattggtgtctacattaaggatacgaagggtggcaataagacatttgtacgtaccatgattatttccacccttgtcgttggcctgatgtatgttctcggtgctattgctgtcgggtttgtggttcctaagtcagttttggcgggcaacttctcaaacgggatctttgatattttcaaaatcctaggaacgcatttcaatattcctggtaacgtgatggtccgacttgtaggcttgattctctttgtgggtagtttaggctcgttggcattgtggacagccgcgccagtcaaagtcttcttctcagaaattcctgaaggtgtctttggtaaatggttggttaagaccaatgatgaaggcaatccaacaaatgcccttctggttcagggtgtggttgtgactttactcatgattgtgccagcactggggattggtaatctcgacagtttcttagagactttgatcaacatgactgcggcaacttctttactgccagttctatttctgctaattgcatatattggtttacgctggaagaaagatgatatgccacgtgatttccgcttcggcaatcggacgatggggttgacagcaggcatcttcctcttatgtgttttcctctttgtcttcttcatgtcaaccgttccggatccacacttgatcgctgaagaattggcgggacatttaccaaaaggaacagcaagtccaattggaacgctgctatataacgttctcggagttgttatctttatgggggttgcttggatttactgggatcgttacgaaaagcgagaacgactcgcaaaggctaaaccagttgttcattaaagacaactctgatcgggaaactcgggcgtgataaacgatcagccaacacgcacgtagcaccgcagactgctcttgacgtttggaatacgtaatgtacatgaccacctcagaataggaggtggtttatgtgcgtaaaaggagtctacattggcgcaaatagcatctacacaagtcaaacgagttttaaaaacacgacatttgtctatgatcgcccttggtggcagtattggcacaggcctgttcgtcgcaagcggtagtgccatcgcaactgcgggtcccggtggcgctattgccgcttacattggcattggactaatggtctttttcctaatgacaagtcttggtgagatggcaacctatgcaccggtttctggttcgttttcagaatatgctagtcgcttcgttgacccagcacttggctttgctttgggatggaattactggcttaactgggcaattacattggctgttgatgtttcgacaaccgctattgtcatgcacttttgggtgccaaacgtacctgggtggctcatttcggtaacgtttttaagtcttatctttgtgattaatttgatttcagctaagtcgtttgccgaaacggagtactggctgtcattggtgaaggtgatcaccgtcattgtttttctcggtgttggtttgttgaccattgtcggtatcatgggtgaaacagcgacgccgattgggttgaaaaactatacgttgggtgatgcgccgtttgtgggtgggttacctgctacattgtcggtgtttgttgtcgctggtttttcttttcaaggaacagaattgattggcattacagccggggaaagcgagacgccagagacgagcattcccaaagcaattaaacaggttttttggcggatcttgttgttctatatcttatcaattgccgtcattgctgcgattattccgtacactaatcctaacttgttgagcggctcggtcaaaaatgttgccgtttctccatttacgctagtatttaatcgcatcggtatggccggagcagccagtctgatgaatgccgtcatcttgacttcggtgctttcatcggcaaactctggcatgtatgcatcaacgcgcatgctatgggccatggggagttctggatttgcaccccgtatttttcagaaaacaaatggccgcggtgtcccaattgcggcgctgcttttgacgacggtgattggtgcactgacctttttgactagcattatggggccgagtgtttatcagctactagttgccgcatcaggactaaccggtttcttagcttggttgggtattgccgtgtcgcatttacgatttcggcgtgctttcgttaaacaaggacattcggtgaaggagcttcgatatcatgctaagtggtttccagttggccctattctggcgattatgatgagtctgattgtgattgtcggacaagacatgagttcattagctgatttccaatggggtaaactactaatttcatatatgtcgataccaatttttctcattttgttcgtttattacaaagtgaagcacaagactaaactaatcccgcttgatcaaattgatttggcttcgcatcatgatcagcgtggctaagcggagttggctgacaacttggcttgttgatacatggataaatagaaactcaaggttgaatggcgttatcattcaatcttgagttagtcatatttgatgaagcagccatgacaagtctagcaacgaggctcgtgtggctgcttttttgtagctgaaggaagtggctttagaaagtaaatttgaaaccttggaaaatgaacctttttaatttgattgcgtgttaagctgtaggtatgtaagcgctacagaaagaaacgggatctaattatgtttaaagaaaacaagtggctgagaacagatcgcattgtttgtcctgagctttcggtatttgaagtgggttatgaagatgttcatccgcgagcaccgtatcaatatgaacagcttgattactatttacttcattttgttttgcaaggtgagggactattttttattaacaatgaaattcatcagttgtcacgaggacaaggctttttgattccgcctcatacggacaacaattactatccattagttggcaatccgtggagttatcgatggattggcgtcagaggacccggtgccgcggctgtctttaatgacgctgggctaggcaagaccaactttatttaccagcaccaggatattcatcaaatggacgacttatttgcagaagcctacgattattttagccgcgatcacttgtatggcgcattgggcaagttctatgagattgttagcgcattggtggatgattaccagcaggaaacacggctaggggtcttgcctaatcagcaatacgctttggaggcagtcgaaattcttaaaagagagtatgcagatagtacgttgcgaatagatgacgttgccgagcgagtgaaagttgaacgtacgtatctgtatcgtatcttcatgaggaatcttggtgtttcacccaagagttacctcatgcaattgcggattaaccaggccattgaactattacgaaatacgaatgatgcaattggcgacattgccatcaaagtagggtttaccagttactcgcagttttcaaaagcgtttgtgaaggcacgccgaatgaccccatctgcttttagaaaagcgatttcgagtggtaaattaaatccgcggaaaattgactgagcatggctattcagtgattggtttgtgtatttatgggttattagggataaggcagaaacttttcagagctttaaaacacgaaaggagaacgtgatgctcaagatcagcttcaatcgagttgtggcggggcggtcatgtaaccacgaggatgaaccgaattgtgcatgtcgacattcaagaaatcgtcagggaagagacaataacccatgattggcgaatttatttgcttttggagggggcggctaaagcgaatgtctttcagtctaattacgagttgaccaagaatgattttttaattctgaatcccaatgaacgattctcgatgcattctgtggagccagcgttagtgctcgctatcaccttcaatgcggtccatttggatgatatcttgccgggaatcagaaaacagcgattttggaattttcctagttcttctgctgaccagacgactgacagtattgatgaatgtcgccagttgttgcatcgtatcatgatcacgagtctttttgaagatgtcgatgatgcggcgattatcgcaagagggttggcgctaataagctatttgcgttcgcattatctttggcacgagaagacccgaagcaatgctggaacagatcagttagtgaatcgcgtgatcgcaaaactggagtccgaatatgcggaagatgtcaatttggcgtcattggccagtgatatgcatgtctcatacagttatctatccaagcgatttaaggagacaacccaacttaattttaaccattatctcaatgcaatccggttgcatcatattgaacaggatctaaagtacacggataaaagcatcactcaagtaggtattgacaatggctttagtcagccgcgtacaatggcacgtaattttcaaaaacaatatggcatgtcaccacagaaatttcgccaagcatttgcgaccaccaaaatgttgccgatgcatagcgggtctcaggttacaacattggggcgtgatgaagcgctcagtcgtttagctgggaaacttgctgacgacgatttagcatccttacaaccagcaaagttccagcagaaagtcctagaagtacagtcagttaaaccgctgcagcgaaaagcggtaacttatgccatcaatgtcggcaatgtattgaatctcaaccagcaagaatgcgttgcgcagttgaagatgctgacaaaagaagtcgtcattgcctacatcagggtgtttgaccttgataaggttaacatcaggccaaattatagctcggtcgtgactgctgacaaggaattaatcactgcatttcatacgattcttgcctttggcgcgctaccaattattagagtgtcaccgaacatcgtggcgcatcagagtccggaagacattgtggcgcgttttgatgccatcgtccgggcatttgggaaaagtgttgtgcgcaaatggattattgagtttgagtatgactgtttgtgtagcgatgacccggatgttcagagggtaattaattattttatccatcatgcggcctggcatcggattggcgtgcatgttactgaacaaaatgtcaaacaaggtaaggacgtcacggttcacacacttgggaatcgttttgtttacttatcttgtgattacctatttcttcggcatgaaatcaaagcagatctagccggactcgggtcgcaacttgaagcgattcgagcaagactcgcacccaatcaagcatatgcacctgagttggccctagatgactggaataccttagctggtagtgacgaggtaacggtcgggactttctttagagctgcactgatcaaagaaattttgcgacaaaatactggccttgataatatcagtttttggctaagtatttccagtcgggctagcgtcatacccactgccacggatgattgtctatcgttatttctgtatgggactattcggcggccggtttattttgttatcaggatgcttaactctctgatcggcgagtgtctttatagttcaccctactttagttgttttcgaaatggtgaagattatgcgctcctattatcaaacccgacgtatgttgacccgcgcatgtctatcagtgatagtctgatgcagtatcaatctcagaaattacagttgcaacttttgggattggcatcttcgcggtatcgagttgtcagcgaattattggataaggactgtggtggcatctataatcaatggcttaaagtcggtgcgatgacaagttattcgaaaagagacattaagtacctggagacgatcacgcagccgagattaaagattaagcttgttgaggcgacagacgggaagctaactttggctgccacacaatcgtttaatagtattcagatttaccacgttagtccggtgatggattaaatagatactgaccttgaatcgcccctgtccgtgttctggataggggcatttttcttgaattttaatcggcataaagtcggtgcaaaaattgtccgacaattctagcagaaaaattaagaggttgataatagacacatgtaagcgctttataaagacgaacaatatcctacttgtttagagatgtccacttaaaatggaaacatgatcaaaattctttaaaggtgggtgacaacatggcgacggttattggtaaaacgtctcgatcatcagaagcaatgctcatcacgtcactgatggcgggctactcgatggtttatatggacaagagcatgatctcaacggcgattattccaatagcttcagagtttcacttcaattccggtcagactggtttgatgatgtcgatgtttttcctcggctattcattgatgcaaattcctagtggatggttggctgatcggttcggttcaaagcgggttcttatggcttcgttgcttattattgccagcttttcctttctgtttggggtggcaaacggcttgctatttttcattttcgtccgcttctgtgcaggactagggcatggcggttatcctccgagttgctcaaaagccattgcagaaaactttccaaaggagcggcggacttttgtgcaatcattgatcctttcgacctcgggaattggcggtatcttagcctttacacttggcgcacgtttggttgatagtaattggcactatgcgtattttgctatgggcacgctcttcttagttgcgtgtttattcgtttggcgattcgttcccaaaggccaacaagcaaatagcaaacaggatgaacaaagtgaaaagccgagtttttttgcaatgttaaagaatcgcaatgtactagttttgtttgtggcaatgttgttactgaacgtcttgctatacgggaacatgtcatggctgccatcgtatataacgtcaacatttgatcttactattagccaggctggtatgatcctagccttgaacgctgtctttcaaaccatagcgactatctttgccggtcaattactttccaagttgtttttgcataaagaaaaacgactcattttaatggctaccttaatagtggctgcgttgttaattgcgttcgtcatgtcgagcaacttatatgtttcggtcgtattattactgcttatcaatatgattagtgtcacagcctttacagcgatctttacttggccgcataaaatcatggatgcgggcattattggctcatcgattgggattatcaatacaggcgggaccttaggaggattcttggcgccgatggtgatcggttttctcgtacaagcagctaaaggatcatttgtgccagctttcttctttatggcagtgatgagcctgctgtgtggtatgacagttattgcggttaaaacaaaagcataaagtaaattaggaggaagagaaaaatggatgctaaagaacggttgatgcaaattgttgaagagaaaaaagatgaatttatcaaagcttccgatcagatttggagcacaccagaaaccaggtttgcagttgaaaagtcagttcaaccgtactatgagatcttggaaaaagaaggtttcacgatcaaaaagggtattgctgacatggactatgcttttgaggcgacttggggttcaggtaagcctgtcatcggcatgttggcagaatatgatgcattggggaatctgagtcaagtggcgggggaggtcgaacacaaaccgcttgttgcgggtggcaacggtcacggatgtgggcataacgtgttgggcactgctgcacttgccggagcggtggccattaaaaccctaatggaagaagagcacctttctggcacgattaaattattcggctgtccggctgaagaaagtggctacggtaaagcttttatggccagagatggcatttttaacgaccttgatctagcgttggccaatcacccgatggactcaatgtcaggatggggcagcagcagtcttgccgtgcttcagtgttactacgaattttctggcacaccggcgcatgctgcagcggcaccggaaatgggacgtagcgctttagatgctgccgaactcatgaatgtcggtgttcaatttttacgcgaacacatcattgatccggccagaattcattatgcgttcattgatgccggtggcgagtccgccaatgttgttcaaccaagtgcaaaactgtattacttcatccgtgcgcctcacgttgatcaggcaaaagccatttttgccagagttaacaagattgcagaaggggctgcgttaatgacagagacaaagctcactaaagagttcgatgcaggatgttctgattttgttgcaaataaaccattaacccgagccattgacaagaatcttgatattgtggggcctttagagctgaccgatgacgaaatggcctttgaaaagaagctttctgacacagcttccgaggcaagtaagcaaaactcatataaccgcgccaaacattctttcccagactggaccgaggaacaggtaagaaaagaagcagaagccggcattgctttgcataagctaccgttagaatttactgacgaaacggctggatccacagatgtaggcgatgtcagccaggttgttcccacggctcaatttacgaatggttttgaaccccaaggaacatcgccgcatacatggcaatgggtctcaaatggcatttcgagtgtggcccataaaggcttattgttaggcggtaaagtctttgcattgacagcatatgatgcactgactaatccagatctggtagaagatgccaaaaaagactttgaagagcattttgcgggtaagcaattcgaatcgccaatcccagctgaagtaaagccgcggtaattaaaagatcggctctcaatgggccgatcttttaattaccaatttataaattttagagtttatccggtgtgcttttttggcaaattcagtcaagatcgttcgccgggttattactttgaacagcagcgatagtctctgaattgatgaatctcagatcgggttctggcacttgatcaaaaacggcatgcgcaaaggttgccaacttttgactataaggcaatggtacgctgagaatcttacctagtctaaccagtggatcaattccataagggagatcttcaataataaaacgggattgtatgttggtaggtgctggcaagttacgataagtagccaatccgtggaacacttcgccgagcgtgtcaaagtcagtcccccattgtgttgccaattgatgcacaatgctactgtaaggaatatctaaaacactagctagttgtttacgctcagtatcgatgcgcataatgtaggctctggtggattcactcaatccatcagtcagaatgtggaagcgttctgcatgttcgattcgaggaagattaaaaagtgagactggaacatgaataataggattgagcgcactaaggctggtctgcaagacgctaggggatacactaatttcggaataaagctgctttagtaaatttaaaccttttcgccaagcttgctgattgccatatgctgccacggtcacttttgttttaatttcactgatgtgtagcgaatgattatgccattgagcaacgtaaggcatgccagaagtctccaggatgctgacatgtttttggataatccagtctggcgtcaattttgcgacagcttgcaacatgccccagttgccatttagaaaaataatggtttggtcttgatggatgaacggcttgatagctgaaatgatatcctcatgtgcattcgcccaggttgcaatgatgatgatatcggcaaagttaacgctggcagctaggttggcgctcactcggaattgcgttgtggttgtgatacgccccgtgatagtaaaagagcatttagttagcttggctgctttaacagggtcccgagaaaatattgttgtttctataccacgtcgcttaagatccgatgcgcacgcaaagccggtattcccagcgcctataatagtcaccttcatactttggcctcctcactggccgcttttaagaatgcggctgtttcttggtgagatggatgcttgaagaattgttcagcaggggcaacctcaactaaattgccttcatgtaaaaaggcacatttggttgcgatatgctgggcaaagtcaagctgatgggtgacaacaatcatggtttgacctttagcgcgtaaagataagatatctcgggtaattgttccgaccaatgcggggtctaatgagctagtaggttcatcaaagagaatgattgaaggtcttaaagcttctgcacgggcaatgccaatacgttgctgctggccacctgacagttctgcaggataaagatttgctttatccgttaattcgagttgtgcaagcaaagtttcagctatcttttttgcgttactctttgtttgatgctgcccataaatcaaaggctcagtaatattctctagcgcagtcttattattaaatagcgcatagttttgaaaaaccattgcaagttgatcacgaattgagcgaatatcactggcggttagatggcgataatcgaaggtttttccccccaacgttagatggccactggtgggttgttccaacaagtccaagcatcttagaagagttgtttttcctgcaccacttttgccaacgatcaccaatgtttcaccagaatttactgttaggttgagatctgaaagaattttcttacctttaaattttttggtgagttctcggatttctaacaacggcatcatcaccacctacttttcttgggcataagatttggttacatctgttacgcgatcatttttggctgtaaaaggatcactccctagccatttctgagacagcttagcaagtgtcccgtttttgcgtaatttagtcagctccttatcaatgtcttgacgtagctgagtgttgcctgcgttcttgtgatagtaataaaccactggaaagaccgcgatagacttggaaagcttcaacggttcgtttagtttcttttgtgcggtatcgaagtttgttcggggataaagaatcgcatcatactgtttattgacaatatctttaaactgattagcggtgtcgacaaagccagatgatttcagcgcaactttttgatcaggatgtttcttattccagtcttcaacgatgccatatcgcggatcggaaacatcaattggttcgagtttgccgttggtttttgcaagagtagccagattggtgatttgattgtcatctttacgcactaccaagcgtaaatcactgagtagagtggggcgccgtgaataatcataggtttttgcgcgttcggatgagtaatagtagtttcccacggctagatcgtatttgcctgattgcaaaccgacaaatacggagttgggatcagtgacctgatattgaaacttatatttactttttagatctttttgaatggctgccagaatagctccgttgtatccggataattcatccttacttttgtagatttgataaggttgagaggcagaaggcccaacgatttgaacagttttaacctttgaattgttgtttgcattgccagagctagacttgccgcatgagacaaggaaaaacgcgaggatggcagacccaacgatgaatgcgagctgagattttttcatgatgtttactccttcaatgtaagtatgtgatttgtttctttatgagatggaagatggcgctaactaaccaatacaagatgagataaatcgtccaagctgctaaataagcaggaatgaactgatacgtcttggaaccaacgaggatactagtccctgttatttccagtaatccaatgttgtaaataatagcggtacctttgacgatatccatcacgctattaaagacatttggcagtgccagtgcggctgcttgtggtaagatgattctgcgcattgcggtcatcttgctcagacctgaagcaagtgctgcttcaagttgggtcggatccaaggcttgataggctgcccgaaatgtttcaccgaaataagcacttgaaaatagtgccaatgcggccacagcaaccactgtagccgggatgtggagtcctttaccattatttaacatggacgttaagtttggtaaggcgaaatacagaatgtagagaacgacaatcattggaacactacgggcaaatgaaaggtagacacccacgatctgattcagtattgggaaatgtttgattcgtgtccaagctatcagacaaccgattgggatcccacagataattgctatgatagcaatgtagatacttatccaggcactaggaagaatttgttgccagtcttgccagaaaatagtcattgtgcacccccagaccaagcgcgccgacgttcaagttgggcgaagagtgcctgaatggcaatacagattatccagtaaatgagcgataacgcgataaacactatcacttggtttttcccaaaagatgcttgagcaattacctgggcttgctcgtaaaggtcagtaattccaatgacataaacataggccgagtttttgacaatcgtgatcagtgtatttccaatattgggtagtgctgcaacaaagatctgcgggcctagtattctacggacagcattgaatcgactgaaatggagcgatgtgcacgcatcgtattgtgattgggggaccgaggcataggcactgcaaaggttttctgcaaagtacgcactgttttccaagccaatagccaagattgcaaaactagtttttgcccaccatgaaatatcaataccaaccagttgggataagaatggcatgccataaaataccagcatcaataacaataaaaccggcgttgcacgcataagactaacgaatccgttgtagagaaacttccaaccaacccaattagtaaagtaagttaatgaaatgagcccaccgaaaactaaaacaaaaatcgccgatgccccgatgatccaaaatgtgatacctaagtatggaatcaattgctgaaaaaccttaacaaatgtcgcgaaccccactactatcagctcctctaaaaataaaaaggtcttcgtctctgtatatttaaatacagggacgaagaccttttcgtggtaccacccttattcttgacgagattgctccagtcaactcaacaacacctaaaatatcgatgtttgggacgatatcgagtcctgtcgtggccatcgcttgcacgatgaccagtgctccgagttcatcttcggcgcttcgccgttccaccttcacacctaccggcagtctctttaaacggtttcacgcttactcttctcttccacgcacagatttatataatgatttgattaattgaacatgagtatattgcttccagattagaaagtcaatcgattttttagacagtaattagagatgaaaattaatatctgctttttcaatccaaagtcaggggttatagttccagatgaattatttgtttcgacaattgccagtgaaaagactttggcctatcagaccccatccccacccaaccctgcatcccacccagcctgcagccgatactcctcctccccaacaacctgcttagccccaaaataagcctcgcgttgatgcgtcgcgttcatcagtgtccgagccatcgtcgtagtgaccacaatgtgatgttgctgccggtcatcctttgtcagcggcaagttgccttcagcgatgcgtgccagttgactgataacgtccatcaacaagttgctgccggttaaaatttcgccaaaacgtgcggcgtgatacgtggtgggtaaggaaagtgagcggcttttttggaagcggacggtgacgattcgttgatgctgccggtttgtgatggcgtaatcaacaagccggtgggtcgcgatccaaccgacattgcggtgatcgggagccgctagcggcatgaaggcgtagcacggaccggtgagcatcttgggcagttttttggcggtcccgtgatataatttctgcacgataacttggcgcatcgttggggagtaaaccgaactgttttcgtgcgaacgaatgaaacctaacgtcgatggcttgatcaggtgtgccgcagtggccgtgagtatcagcgtttttcggggaaggaaggacgctggtaaagggagaatcgccaaaatctcctttaacggcaactgcgaggcgtctgatgctgtggcgttatgggcgagttcagtcacgagatagtcgggatcatctggagcggttttgaccatagccgcgttatgtatggctcaattttagtttaaacttatgctaattaaaagctgaaaatgttaaacgcggtgaatttatggcgcaaaatcgcgacaggtgttcaggaaatggcaacaaattgtctagtattggctgattttatcgagcttaggaggtaattgggcgaggagcgaggtgggtgtgttatgtatgaagctgcctttttggtgtgagcgtgagtcagcccaggttggctcacgcgttatggtgtgacgtgacaaggtaactgaaaaagtcgatacttaatgaaaaacgcgtccggctgcgacacccggatgcgttttttgatgggcgtgagccggcgtggttagggatcggagtataagtggtcttggtcgtgatgacggggttttggccattgcgaccaagatcctgacacgcagattcctgtgccggtgaacgcgttaagaagcgtgtattttgatggaagtgcgatccgatgaggtgaaaagtcggggagcacttttttaaatgcaaaaaaaagttagctgaaaatttcgcgcaatttatgtttgaaaaggcgataaacccaggcctgcacagataaatacccgcactcactaaatcgaaagcttgatagaacaggttttcactcatctgattgcgaccaagacgaatcactgcttgcctcgttaaactaaccttatcgatatcgaaacaaacaaggcgccggatcggatgaagtgatggtaacagaagcgacaggttttgatttttttcttgcgcatcaaggagtggtttatggggcgttggcgcggttggggattcatcgtggccgcagtgattttcaggattggcgggatgaagggatgttggtgtatctcaactacttcaaccgttatcgcgagccgttggtggatgaggcggcgattgcaaagttcaataagttggcgtggcgtttcgtgtttctgaccttgatgcagcggctgcaaaaagcgcagcatcggcgggagttggaaaacgtaccggcaaatacgacgcatattcaaacgaccacgctggcgatagcgccggggagcttgcaacaagcgctggaattgaagtggcagttgcagcagttgcacaggctgttaaccccgatggaacgccatgtgttgcagttgcggttaagcggattgtcagatgctgccattgccgcccaactgcatgtcagtcggcagcggattttgcaggtgcgcaaacgggtgcaggcaaaataccgggcgctgagtcaaaactgtgcctcggtttaaccgaaatgggatgcgcgattgcgaaagactgtagcaaaacgctgcgttcctatccgcatgctgaagatagctgcaaatcagcgacaatcaattaacttttatggaggataacgcaaatggataaagaactattgacgtatgtattagatcaggcggtcggcgtcgtcattgccgtgattttactcacgcgcattgaacggcgactcgacacactgattacacatatcgagacgttcatggccaagcttgatggcaagcaattacggtaggaggggaaaagatggcgatgttaatggcagatgtaagcagttggcagccggattcggatagctggtttcgcaagttggctgatctaggcgtcaaggcggtggtcgtcaaactgacagaaggaacgacttaccagaatcctaaggcggcggcacagttggcggctgggcgcaggatggggatgcaggtgcacgcttatcactatgcccattttcataacagtgccgaagcggtggcagaagggcgtttcttcggtgtcacggcgcgtgcgctgggggtgtcgacgcaaagtgtgatggcggcggatgttgaagcacctgatttgaccggagagctgacggggttgacgaatgttttcattcagacggtcaaagcgctagggtatccgcacacagatttgtatacaatggcgaactggatgaaaaccagacgctttgatcgtgtggccttgattcccaagaatttatggatcgcgagttatggcgttgatcagccgggcatcgataatgtcgggacctggcagtttaccaataactttcatggtttaggggtggatatgagttatgactttttcggtcactacaccacgcgcttgaccggcaatctcaatggcggcgtggcgctcgttcccacgattcgctatcacacggttttggcaggcgaaagctggtgggcgattgcggatcgatatgggttgaatatgtacaagctcgcggccctcaatggtaagacgatttacagcgtgattcatccgggcgatcagttgcggttgaattaaagcaagagaaattgttaatttttattgcgaattggggatctaaagtctctgagatttaaaagatcagctaaaaataaaggcgaacgagttttcctacataagctatcacaaatatatgcaatagctgtgggaaaagtcattcgcttttactttgtgctcttcattttttcctatctggattattcagggattgtaaagactagggctggagcggtaaatgttaattaacttgactccatttgatctttaaattggtttcgattagatttccattgtctaatgcaaaaggctcaacaaccgtgtgcccactgctgtcagtaaattgaatattgaggatgtttccggatcggtaaactattttccacgtgccagaagtggattttccatttgttgttgagctataagtaccgtcatcgttgaagtcaaatgtggttgcatcaccagactgccagtgcccagtgataccggaagatgaggtgttattatttcgcaatgaagtattggaaggatagttcttagtggttttaacaacaccgtggtcaatgtaatcctcattgctaaccgtagccgctgatggatctgtatcctcttcatattgtgaggtctcggcatcatcttcagaatcataacttgtctcttctaccgaattagcgtcactgttgctactactttcagatgtaacggcaggcgttacttgaccaggttgtcctgaaccagaagctgatgaggcactatggaaataaagtgctaaaaatgatacggcgatcaaagctataactaaaaatacgaaacttaaaattatacggttacgatgtttttgcttttcttcatacagaattcgctgtaattcagatctaaccgcaacatttggtgctttggcgatttctattctcagctgcatgatacgatcttggtatttttcattagcgattgtagcggaaagctgttctaaatccgcatgttgttgttgcgcataaaaatcattggaagaattatattgattaggatcataccccattttccccacctccaaaaacattatatcagttattttataacggctggtgaaattcggtttgtttcccaataatcaaggagccgcaaattcctacttttcagaatgtttttacaatgttgcataaattaaagttgacaccgtgtcactatccgtgtagactacaaattgttgaacggtgacacggtgtcaccatgcgtactcgtcaccaccaaggtttaaccgtggcggcgaaagcttaaggaggatcaacatggttttagcaacgttccaacatttagatcaaacaaaacagcaacgggttctggctgcgttggtgaccgaattttcgcagcatccgttggcacaggcgcaggtggcgcggattgtgaagcaggccgacattgcgcgtggggcattttataaatatttcagtgatttaaaagatgcgtatcaatatgcttttaaagccgtgatcgggcggttgcatacgggcattgcgggtccggaaatgcggcgtgatccgtatgctgccaccgcggcgttcttgcacgaagcggatgaaagtcaggatcgtgattttatccgcatgcattttaccaagaatagcgggttggtgacggttgggcagcccccgattccggccaatgcgattgaatgggcggtggcgaccttatgccacagcgcgatttccgaggcgctggccaacccagaacagacggatttgattttgaagcatctaaaagcagcacttaaccagctgcaagtgaaggagtagtgagtcgatgtatctctcattaaaagaaatctggcatgaaaaattacgttatggcttaattatcgccatgattctgctggtcacctatctggtgttcattctcagcgcgctggcaaacgggctggcgcagcaaaatacccaggcgattgaatcctgggacacgtcccgagtcgttttggccaaggattccgatattaacttaagccagtccttgttgacgtctgaacagaccaagaatctcaagctaggtaaaagtcaggcttatgtcggaacaatcggcgcggtggcaacgagcagccagcacaaagaaatccgctccacgatgattggtttggattggaatcaatatattggcaaggacatgaagctggtcagtggtcaccgggttcaaaacgatcatcaagtggtggtggacacacaattcaagaatgaaggttacgcgcttggcgacaagattcgcttgagtaccaaaggcgatcgctacaccattgtcgggtttacccagaatgccaagatgagtgtggcgccggtggtctatggcaccatgaccacctggcgtaccttgcacaatctgccaaccagttttaccgccagtgggatcatctccaagacggccgattttaaaatcaacaccagcgacctcaagacgtattcagccaacacgtttattcagaaactcccagggtattcggcgcaaaatagcacctttacctttatgattgggttcctgtttgtcatttcactgatcgtcattgctgttttcctgtacattttgaccatgcaaaaactgccaaactacgcggtattgcgggcccaaggtgtaccagcacggaccttggttgcgaccacgattgatcaggcactgattttagtcagtctgggactcgtcttaggcggcgcattgacggcgattaccgccaagttcatgccgctgggtgtgccgatgattttctcggcgggactcagtattgccgtcatcttaggcatcctgctcaccggttttctcggtgcgattatccctgtacgcaccatcttaaaagttgatcctgttaccgctattggaggttgatgatatgccagcaatcgaattaaaaaacatcattaaaaactttaaaacgccaaccagtgacgttgaagtactcaagaacgtcaatttcagtgccgatgccggcagtctctcactggtactcgggccatctggatccgggaaaagcaccttcctaaccattgccgggggaattcaaaccccgactgacgggattgtgaccacagccggggaaaatctggaacaactttctggtaaagcgcgggatgcgttgcggttagataaaatcggctttgttctacagtcttataatttggtgccgtatttaacagtcggcgagcagtttaagctggtcgataaaatcaaaccaaaagggaaccttagtcaggcagccctttctgagttgttggatgatttgggtattgccaacttagtcaatcagtatccagcatcgttatcaggcggccaaacccagcgtgttgcgattgcgcgggcgctttatccggatccggcgattgtactggcggatgaaccgactgcggcactcgatagcccgcgggtggcagtggttggccagttgttggctgatcttgcccacaagcataacaaagcgattgttgtcgtgacccacgatgttcgccttgaaaagtttgctgatcggaagtttacacttttggatggcaagttacgtgaaggcgaaccggagtatgcggcataaggctgtgcgtctttaaccttcatgaccatcatcgtgcagatctctaagcgcgccagttcacgctcaccataacgcgttcgccagcccagaaacctgcatgtaaggaccttaaccacaatggccaaagaccggccattgtggttaaggccacttacactccggtttcagaccgggctggctcacgctcactcaaaaaagaccaagctcactaaatcagtgaaatcttggtctttttgcatggctgatgattaaaagaggaaacaatgttgcagtaggattagcaactgactagaagcgtggttcacctagtgcgtgttgagcggcgaggttgagcaggctccattgccggtcgaatcctggctggaagaagaagtcggcttcagctaagtcttccaacgtgaggccgtattgaatggctagggccaaaacgttgccttgcgcggtgacgtcgtaagtggacagaactgcgcctccaagcagccggtgcgtttgcggatcaaagacaaggttgacgcaaacttgcggattaccattagcttccggaacataagccggacgcagggaatcagcgtaaaaagcggtgtcgacttggacatttgagcgtccggcagtgaacgtatttaagccgcttgctgcaaagtggtaatcaaacacactcaacgcgctggaaccgacaacgccgccaaacggacgtgccggatgttctgcaaagatattagccgccagataacgggcttcacgccgcgcaactgttgccaaggcaatcggaactttttgctgtgccggtacggaataaaccagcgttgcatcaccaatggcgtaaacgtcaggcaaattcgtgcgcaggtatggatcggtgttgatgaaaccgcgatcgtctagcgaaaccgtgcccttgagccattcagtagctggctgaataccagcagcttgaatcacaaggtccgtggcaatttcgccagcatcggttttcacggcgctgactgcaccatcgccggtgaacgcttcgatttttacgccgagttttaactcaacgcctttgtcagtcaactctttagctaagatgtcggtcatatccggatcaagataggtacccagcggccgatcaatcatatcaagcaaggtgacttctttacctgctttgcgactggcttcagcggcttcaatcccgatgtagccggcaccgatcaccgtgatatgcttgactgccggatctgcaagtttggctttgatactggttgcccaatcgtaaccgcgcatcaggaaaacatttttcaagtcgttgcctggtaccggtagtgagttcggccgcacgcctgaactcagaatcaatttgtcgtaaggataatcctgtgccgtgccgttcttcgtgtcgcggacagtaacggttttgacatcagcgttgatggccgttacttcatggttgttgaacacatgcgcaccacgtttaattaaatcatcagggcggaagttacgaacatcattcacatctgtgacctgatcttctaagaataattccatcccgcaggacataaacgaaacaaagtcacccgcttcaaacatggtaatttctgcatccggataccgatgcaataattccagaacgctttggtgaccgccgtgtgatgccccaacaacaatgatctttggcttgtccacaaaaatccctcctaggatatgtagtaaccgcagttatgtaacaacggctctatctctatattagaataattacaatctagcgtcaatagcagagaacaattaattattggacaattttattttagctttacctaaacccaatgatacaccttggcgtttgaaaattgccaatgtgtcggtctaatgggtaaaaaaaaccgctgcacagaacattgagggttctctgcaacggttttgcatgtaaaactagataattttaaaatgttttagcgccttaacaacgccatcgtcatcattgctggcggttacataatcagcatggttcttgacgacattctgaccgtttgccatggccacactcactccggcaaaatcaaacatatcaagatcattgtgttcatcgccaaaagcaatcacgttggctggctttagccccagatactgtgtgagttgcgccagcccccagcctttatcgaccccttgtggcataatttccagcataaacggcatgctgcgaatcacggtaaaccgattgccaaattcggcttcggcttgcggttgaatgttagccacctgctctggttcgccgagtaagataccttttgcaatgacaaaatcatccggcatttcctgaggttcgcgaaccttgataccggcgtgattttcccatgcctgcaaaactgtgtaccggctgatgtttcgatcggcggtgtagacgtcaccggctggggtcaaaacgttgctatcaatcccggccgccgataccgaggttgcaaaagtcgaaaaatctttataatcctgatggttcatgaatttttgcgcgatgattttcccactggtactctgaaccacaccgccaccttgaacgatgacatattgatcatcaccatgcagtcccagcgcgtccaacgttgtccgcacccctggcagtggccgcccggtacacggcacgactttgatcccggaagccagagccgtttgcaaaccctcgaccgtggccggtgacaattgcttatgcgaattcaataatgtgtcatccaaatcgactgcgatcaatcgaatcatggcagtcacaccccttcctgaaatcagcttagcacaggggcgttggtggcaacaatatgcaaccttgccgaccagcacaagtccggtgaaaagaatgctcgggcactaagccgtcacaaccgttaaatctcgccatggcggccgacatcaatcaagcggatcgcgtctggttcaactcggtaaatgagcagccaattacccttgatgaacaaagcacgatctggtttgcgttttttgatcacgtgatcgtcatacttttccggcagtggggtgctggtttgtaagtaagcaagaacttgctgaaagtcagccttagtgaagcggccggcttgtaggagttgtttgagatgttttttgaagcgggattgttcgataaggggcagggaggtgggcatggtagggacctttctaaaagtttgggttaagcatactgcaagaggggagcaggtgaagaataatagttgagcaattgtaagctcagcaacagagagtgtgactttccaattcactgtgttgaagttggatacgtacttagcgcaagcgctaatttacaagccgctttaacatataaccagcaaaggcttttaactcaactgcctgatattcactcacacgtccacttccagactggtattcgtttaacgccatcttgatgagtggacgccatttgggggataacgttgctagtgcccactccccaccggaagactttgatgtgacgagctgttcatttttaaacgccaatgcccggcataggtttaaaatcgtatacattggctgatcaataattgtagtgtctgcattgccaatgtcataaagaatacttcttaaatatgcttgggcaggaactggtgcgaaaacttcggagattggttctccggttaaaacttgaccacattgattgacgatcatcaaatgtgccgtgagatcggggtcggttccgtgcatttgattaatatactttgctggttcgcgcaaatactcttgatagtgcatttttgaaaaatgaaaatcaaagggaacgggttccgaaaaagtagataggtcttgtttaagaagaatgtgaaattccaatccttttgccggactcaaaggccaaagcttctcaagtgttacattcatgatactggccttagctttgttacttagcgggctattgacgacaacaagatagtctaagtcgcttactgccgggttgaaacagcccatgacataggatccgtgcaagtaaataccgactaaattggtggttaagatgcttgtataactggtttttaaaagtgtcagtaattgattggttttatccacgcttatttccccttcagtcggactcgctagctttttaggcactcaataacaagttcaaaataggcaagcttatgaaaaatacccatccgctagtttgacttacgggatgggcgctttcactcattgatgtgcagtcgtgtcctgagatgtttccggtaacttgatcgtttcaacgcgcacatgctgcggatttcctcgaagatactcactgatttgttcggcacttttttctatgtttgattttgacattgaaaaatcctcctgctttctgattcacaacgattgtatcttaaaagccgctgattttgttagcttttaatataagtaattgacgactttcaaatagtttagcgattgaagccaaaaagtagtgtgtgaaaaggcgggagagcaaagagttactggcttctcaaatgaaaaaaccatcgcgccacaatctgatacagcacgatggtttgaaactagcttcaacaaaagactctttcttgtatttaccctttttaaactttttcatcggcacaactcggccaactgtcagtttgttatcttttttggctttcacttcaggcgttgatgactcaggcgccaaacccttgattttttcatcgacggcttcagcaaaatttttgacttgttttgctgaccagagacctttattggcagttgaacgaataaacgctgccaaggcttgtaagaccggtttacgttgatttgctttgatgacttccttgtcgcttaggatgaaggtcagggttgttgaaagttcttccttggtccacgcttttatttcgtgattgaacatcaccttattactttgcatgattagcaaaactaacatggtgagcaggtcggggtcttcactttttccggaagacgatccaaagcggatgattcgatgaaacgcgaaagtaaatccaaaagcgtttgggtttgcggtgaagagaagtcaatggctttttcctcgaattccgggtcattttcgacgtcagctaatgctttttcaatttcggcatcatagccatcatcctcatcatctacagcttcgtcatcatcgtcaaagtaatggatcatcgtcatcgtcataatcagcatagtcggcgtactggctaatagcagcgtgggtagtggtttcggtgagtgcctggatgagtgccgtcatgaaatcatcgctggtgagctgaatctttttctgctgaatcagccacatgatcattgcgcgaataacgtctgcatcaaagtcaatgtcagcatatggatcatctgaattcgccgatgcctctaaagtttgttccaagccatcaacaatttggggaatatcgagtttggcaatgcttgagcgaagatttgcaaacgcggtggcgaaaaatgttatgagcgtcgaacgggcttgagaagttgccccccaacccacgtcgtctcttgaagcagcttaacaaaatttggagtggtgtgaaaatcgtcccaatacttatcaagttcacggcctgcgtggcgcaacattttcgtttcataagttaacttttctttagccattgccctgctcctttatttataagtgaggctaccattagctttagtttggcaggtgcaaggaggtgtgcctagtggagaacacgaggggatttggaggggattttgaaacccatgtggaacaggttgttgctgtgccagttatgtgcgaaaaaagatgattcataacaaatggtatatatggaatgataaagtaacaactgataaactaaaaccaacaatgctacgcgacggcggctctttttgaagaagggggtggtgcttatggtgtaaaaacgataagaccgcagaattctttagaaaggagcagaaatgtccgacttcgaagctttgagcctcatgatcatggccgcactattgttaatcgccgtgatcgagttggttctaaagctaatcgatcgtgactaacaaaaaagccgtcacgaaagcttgcaggcccgtgatggcttaatttagtcagaatgagccgccgtcaagcagcattgttgttacagagggtcgttggttagcagccagcgactcttttagtacacttttattttcagtgatccgtgcagagatgtcaacatatttgtttaggatttgaggcgggaaaaagaaaaattactagcctagattaataacaaatggtatatatggaatgataaagtaacaactgataaactaaaaccaacaatgctacgcgacggcggctctttttgaagaaggggatggtgcttatggtgtaaaaacgataagaccgcagaattctttagaaaggagcagaaatgtccgacttcgaagctttgagcctcatgatcatggccgcactattgttgattgccgtgatcgagttggttctaaagctaatcgatcgagactaacaaaaaagccgtcacgtcagcttaacgggctcgtgatggcttaattaagttagaatgagccgccgtcaagcagcattgttgtttcacgggtcgctggtgtttagccagcgactctttttagtacacttttattttcagtgatccgtgcagagatgtcaacacatttttctcggtgttaagaattgagaatacgatcgggctctttacatgttaacgttttaactgatagaacaatcacaaattggcaaacatcaagttgctatttagtggctggtgaattaggcaacattccggctacctgaaacgtgaatttgatagtgaattaagatggattcctgcttatattttacaaaaatcaaaattggtccattaaaaagccttaatagcatctttagattggctagattgatcgcaatatcaatcgtcactgcgatgctggctaccgttttagtccgcaccaatgaaaggcccaaagggcctttcatgaaggcaaaaccgcgttcaattttcccgcgccgcttctctgcgtcacgatcaatttgccgctgcttagcatccatctttttaggcttacgtcctaaacgtggtcccgacaacctaatgcctagtcgttgacagagctgacgattctcgcgggtacgataaagtgtgtcagctaagatttcatcgggataataaccatgcacgtcgaaataatgatcgatggttgttgctaaatcttggctttcattgaacgccttaaaatcaaatcgttcgatatcgatcatgccatcggcaattgaagcatcaattttgggaccaaattcggttcgttgtttggctttaccacggttaatcgggcgaatccacggttgtgccaagctaacaatccgtcctgggacccgatgggtccgattttcatacatgaacatttgctggtcaaaaagttcacgaatcacagccaatcgtttggtttgcctttcgttaagagaggcaccgtgggccaacagcacatcgatataacgtagatcacgtcggacatactggagctgtactttgatctgcttgcgtgtttccttagcccaacgccgcggttttctagcaaaagcggtccacttagcttttgcttcacgtttgtaggttcgtggaggcttgatttgcaactgatgagccatgtctaataacatttcttctagattgagccgagcttgatttagcagcgaagtatcttgtggaaaacgaatttcaattggcaccgcagtagcgtctgtgatcaagacacggagctcatcatctggcaataagctttgaatttgttcgcgcaaggtatcactgatgatatttcgcactagttccgttatttgacccatgcgtcgtctaaaataaaccaaggttgagtggttgaacggcaggtcggttgtgtaggtgtctagcccgataaagtactggtaagccggggtatcacgaatagcggtaacgaccgaacggtcggttagatgttctgcttgcttgatcaaactggcaccgtaaagcagacgaaagggtttagcagcgcgcccacccatctcagtaaaaagaagttgataggcttcatcgagctgttgccacgggagcatgtcggctaattgaacccactcattgtcggaagagagtggcacaccaaggccgttgttaaaggattgaaatgacaattgggtagcacgatgtcgataagccatgatggtttcctccaggaaaaataaaaagtgcaaggaaaacaggcgttagcccatgtttactttgcactaattataatctttactattctttgatgccaataaagcttgcagttatgctgctttcaccagccactatttatttgtgaagagggtatgatgcattcaataacgtgacctgtttaacgagaatagcgttaaagatgttattaaatcaacacttcgagaagaagattagccttagcgcaagcgttgcagagaacccggatggtgaaaaaggggcgttggcaaaaaggtgaagatgagcttcgaatagtgattcgtgcggttaacgcctgcggatcggttgcagccgttatcctgccaggtatcaacaggtactggaggcgatgtttcggcattgcaaacgagggtggtaacacggcatggccgtcccttgacgacatttttggtggtcaagggacggccttttttgaattcagcttgtgtcggttttggttgaaaagtgatgatgaggaggcattttcatgcgaagttgggaaaaattagtgctagtgggtgtggcgttgttggcgttggtcagcgtgatagcttgtggaaaaactaccagcagtacggcgacttcgagcaataagacgattgtaattggcagcagtggctcggattatcagatctggcaacatattgcgcaatcaccgcaagctaaaaaggctggtgtgaagctcaaagtcaaacaggtggcagacggcaatgtaacaaattcggcaaccgctgaagggcagttagatgtcaatgcgtttcaatcttacgcgtatttcgaacagtataacaaggcaaatccaagtcaaaagttggcggcacttggcactacctatttagagccgatgggattgtattccaaaaaatataagcgattaagtcagcttcctgatggtgcaacgattggcatttccaatgatccggcgaatgcaacgcgcggtttgttgctgctggctgcggccaagttgattacgttaaagccggattttaatgccttgagtaccgtcaaggatattcaaagtaatccgaaacatttaaagttcaaagaggtggatccttcagttcaggtattgcctgacctagatgcaggattgatatcaaatacgcgtgctttggatggtgggctaaatgttttaaaggattcgttggtgcatgagaagctgagtcaggatactcgtgccaatgtgaatattttggtgacggcggttaaaaataaaaacaagcccgaacttaaaaagttagtcacgctttatcacaactcaacgattcaggcctggatcaagaagactttttctggtactaaaattgaggtgaataagccgattagctatttacaaaagaaatagctttcagacagaggcggctttgctaggtataaatagacgtattttctggatctggcgctaaaagatagccgactcagcgtataataacagttgtatcgttatcgaaaaagcgagttgtccagtgaaaagatcggcggataattgcttagctgaataccgttcaccgtcattcacacatagactcacgctgacaataggaggttttatatatgtgctcatccatgacaattaaatcgcttcaaggggatattttctggggccgaacgatggactataacacgagtttcttccacgagtcgcctgctggtggggtgccggggaagattgtgagtttgccggcgaatcagacattgccagcgcaaacggctacttggaagactaaatatgccgcagttggcgttggggtcgatcaaagcgtggcgctgtttgatggcgtcaacagtgaaggtttggccggggacttgcaggtgctggtggaatgcagctgggcaagtgccgagtcactggcgaagcgcaatctgaagccgattaaaggtgaggagtttgtcacgttggcgctgacgacttgcaagaatgttgcggaagtgcgcgcacttgcgagtcagtatggactgctggacgagccgtttcagtttggtggtcaaggcgtcaagattcctttgcattacacgttcgttgatccatccggtgccggactcgtgattgaactgactggccatggtgccttcaagctgtatgacagtgtcggcgccatgacaaatagtccggaatacgggtggcatacaaccaatttacggaactatgtcagtcttaatgatcgcaactatccggaaggggccgatcttggcgaccaacatctggagccgattgaattaggaaccggctatggcatgtttggcctgccaggtgattatacatctccatcccgctttgttcgggcgatgttcgtgtcgcgcaacctcgacccgttcaatagcaacgaaggtatccgcgtgctttacaatgcgttcaaaaccgttttgattcctcaaggtctaggccgcgacccgaagcattcgattttaaccgattatacccagtactggtccggatacgacctgagtaagcgcgccatttttgttcaagacgccaacacgttaaccatgacgaccaagacactcgatccgaacctgactgaagtgacctatgatgatttggttaaaacggaacagtttaatcaactttaagtaagatttgcgggcatgaaaatacgaacggtgccctacgcttaagcgccatttcttaagcagcaggttcagcagattgaataagaaaaaagacgtctcaaccaagtacggattttgccatacctgattgtgacgcctctttttatgcggttaattaaaaacgctgctggttgacatgattactttttgtggcgacctttctgccagtctgccatgggaatgacgcgatctgatggacctgtcgccggtgttgccgcggctgtggcttttgggggtgtcgccggtatcttggcgagtgcttctttgacctgtgcttgggcggtatccgccaaagccttgagttgcgttgccgtccaaagatgcgagttggcagttgacttaatgaagattgccagcgatttacccagtgcctgctgcttatcacgcggaacgatcttcgtgtcacgcagcagtagcaacaaagcagcgccaatatcctggctggtccactctttaggttcgtgaccaaacatgttttgaatggtttgaatcaggaaaaagatgaccgcaccgaagaactcttcgtcttgagctgaatgcggtagttgatgccaggtcttagagtcgaaaaagagcatcaattgttcaatcagcgtagccatgctcgctgaatcgatcgtcatgtcgtcatcgtcgtcaaaacggtcgtcacgttggccggcacgtggcgaagcaagatcgccttcttcgaccagtcccaatacataagtcgtcgtgagtaaggcgcccatcaacgcatcgacaaaatcaatgatggtcaacttaacgcgtttggttcgaatcaaccaaatcatcatgctcttaatcagctcggcagcaatcgcaattgcttcactacgccggcgatgcttatcgttgatttgttgcagcgtggtttcgagtgcgattgaaaccgcctcggctgaaagggttttaatcgtcgagcgcagattttcaaatgactcggaaaaaaaagtgacgagaattgaacggatttcttggggcggaatttttgcgaaatccggatcctgcattaaggccgtgtagtcgctgcttttttgaaaatcaggccagtaaagatcgatttcgcgactggcgtgtcgttgcagttttacttgatagtccatgatatgccctccatatacggtcattgcgggttttattacccttagtttaacaggtgccaggtggtgctcacataaaaacttgctgtgggtgacgagagaaagtgcagaaaaaattgacgctgaattttcatgctagttagcgggggttgtggcagggaacgggggattttttagcatttaaaaacaggcatctaaagatacattacgcatctcatatgcctgttacacttttttggtcaataaactttttaaattgcaaatagcgcgtggttattcaaacattttcttggttgcgcgcattaaagtcttgatatctttgtcgtatcttggcgtgtgtacgaggtggctcatcgggatgccggtgaagtgataagccgcaatttcgcctgaacggaccgcgctttgttcggtgaagaccatctggaatggctgctcggcaaattcaccggtgaaagcgaggttggttgagtgggcgggaatgacttccggtcgatcaactttggcgcgattgttgaagagggccgaagcatacggcatgtaaaccggaatgttgttgatgatgcttgccatgatttcatcttggcgatcgcgaatgttgccaggacccggatcgactttagcaagctgaccgatcagttccaatgccatttccttccctgtcattttgatgtatggcttgttaacaaattcaccataacgacgtggatataggaagtagccccacaaaacggtttcgttaggtttttgggtggtgaagtgcggttggtgatgcaccacaatcgacatcatcacgtctttttgtccaagcgcggtgatgggctgggtggataagaaagagttcaacgcattgccagggatttgggtggtaatgcgctcgatttcgttgagcagcaagtgatccttggtggttaaggtgaagctgacccactcgctggctgcccgatccgcgaagaacttatccgggttgcctaggttgtagaagtggtccgtggcttgtttccataagctagccgcggcaccgtagtccatgttttcaacagcaggatggtcaaaatcaccttgagtggctgagtcggtgatggagccgttagtgaagaagacggcggtatcgtcatccacgaccacatgttccggcttatcggtttcggtgttcagcattttcaaaccggttaccgtgatttcatcggtcatcgcggtgtctttaaactcgaatgctgtgacgcggcggttgaggatgatgcggcagccttgatctttaaggtaattgatcagcggcaacatgatgctttcaaattgattataacgggtgcggttgacgccgaccagatgctcgatttgggtgaactcgtaaatcatcatatgcatgtaccgtcgcaattcctgcgctgaactttcaacgcggaaggcaaaagtggtttcccacatgtaccagaagttggtttggaacatatgcgggtcatctttgaagtagtcggcgatgctgacattgtcgagtttctcttcttccgaatccggcatcataatcagcttggttagcaaaaggcgatccttgttgtttaagccaaggtgaccggcttggataatgccgatgccgccttccattaaccgcgccttatcaaacgtccggtgctgagcgtcaaattgccgggtatcttcttccgccgtcaatccgggttcagttgccgatggaatgcgactcagcaagtccatcaaatcgacataggttcgataattgagcatccgcccaccgcgcgcgacgtagcctttggtgttttccattggatgatatttattccaatattcgtctgctgtctcttctgctggagcgccatcgttggacccgtgatcgtccagagaatagaacgtaatctgatcaccttgccaatgaccttcttgaattaaataaacagcggccgccatgttggctaaccccgcaccgatcatgatcgccttatgcttgatcattattttgcctcctagcgactttcaaacttcttgtatgcgtcagcgtcatctttaaacagttccattttgtttgcaaagtagcaagccgtgccacctgcaaccagcgccaatcccagcgccgtccacaagaattttttcatcataaaacgcttcctttcgctttctgacttcattatagccaggcgaaaaagaagcgtctttagtcaaaatgtgatgtttgttcgaaaattaacgttcttttccatgcgcctgtttgtgcacgatgaacgcaattgaaccattcagcatgagatccgctcgtttgatcaggtcacgctcgggttcttgcaaggattgggctagccacaatagaatctgacctacgatggcggcaccatagaaattgcaaatatcggccaccattttcgctggggtggtgggatcaatgtcgagcaccaccggcttcaccatgtcagtcgctgattgaaacaaaaactcttccagcatgtcacggcccacggaatgataggcattcaggcaaaaggcttggttggcaatgatgtaatcgagcaccagttgatacttggcctcccaagtcgccgcaccgagattctgcatgactttacggccaatatcggcttccagcgtccacttcaacaagccgtagatgtcttcaaaatggtaataaaaagtgttgcggttcacgtgtgtcgcggcacttaattcagcgatggtaatgcgatccaacggcttgtggtgcatgaggtctttcaaggtcgtcgcaaattgcattttggtttggtcagatgtggccatcacgtttcactcctgtggttaaaaaatatcagtttacgaatgcgaaaaaccgcttgtctgcaagggatgccgacaagcggaaatgaaagttacttgacctttagtggcttcaattgggcttcgattttatccaatgtcacgttagcttccagtaaagccgcagcggcgtaagcaccttccacaaaggccacgtcataaacgtgcatctgtttgtcgctgacctcttcggcaatatccaaattcattttggcactgccgaggtcgtaaaagacgagcaactcggaagccggattgtcgttgattgctttttgaatatgatccagatccgttccgatttgaccatcactggtaccgccagccgtggtgatcggaacatctttggccacttgtttgattaaagtctcaaggccgctggcgatggccggcacatgggagacgagcaacatgcccattgccatgaaaatcacactcctttggtttttgacggtaatttgctgaaacgcgttcgcaggggccagaaacctccacgtaaggaccttaaacctaaatggccaaaacccagccatttaggtttaaggccacttacgttccggtttctaaccggccctgctctcgctcttactgaaacgcgttcactggcgcagagatctgcgtgtaaggaccttggtcgcaatggcaaaacccagccatcacgcccaaggccacttacactccgatctctaaccgcgccagttcacgctcttgcctctaggtatgcctttagcagctctccagttgaggcagcgccgggatcgatgtggccgacacttttttcgccgaggtaagaagcacggccgcgtttggcagtcatgggtttggtagcttcgacgagtttgtcaatggcagcatcgtccagcttgccttgtttgattaagtcagcggcaggggcccagacatctagcatggtcttgtcgcctggtttggcttggccgcgtttggcaatgccttttgctgccgcttcaaccagatcgccgaagtcagtatcggttttggcgagtttggccatttccagaaaagcagtgccgtacaatggaccgctagcaccgccgactttactgagcatggccatggcgatggtcttgaagtcttgggcaagatcagcagttggcggcgttttttcgaatgcagccttgatggcattcacgccacgctccatattgttaccgtggtcggaatcgccaatgacccgatcaagttcggtgagatggtctttttgctgcgtaatgcgattttcgaaatttgtcatccatttagtcaaaatttcagcggttaacatcagtatccccccagccaacagtgtgtgcagatgcattcagatagttcaaccattgcggatcgtctagtgccagcatcgtcagtgaaacccctgccatgtcaagtgatgtgacatagttgccagccttggtgaagtcagctttaaggccttgtgcgtgtaactcgttcaaaacatcacccatgaaaatgtattgttccgacagcggggttgcacccatgccgttgactaaaacggcataggcatgcgctttaggatctttaaactcaacggttaacttaccgatcaattgtttggcaagtgctttggaagtcggcaacttttcctgaccagtgccaggttcattgtgaatcccaacgccaaattcgatttcatcaggcttgaggtcaaaaccgggtttgcccacttcaggaaccgtcgcggcgtgcagtgcaacggcaaacgacttggtatttttaaccacagcatcgcctaactttttgagctcatctaggctgagaccggcctcggcagccgcgccgattatcttttcgacaaaaatagtgccggcaacgccacggcgaccttgtgtatacagcgaatctttgactgccacatcatcgtcgaccaccacggattcaacgtcaatatcgtcgacactggcgagatccttggccatgtcgaagttcataacatcgccggagtagttcttgacgatcatcagaaccccttcgccttggtcaaccgccttaatcgcggcataaatctgatccggggtgggtgaggtgaagacctgaccggcaacggctgcatccaacatgccttgaccgacatagccggcgtgcagcggttcgtgacctgagccgccaccggagataaccccgactttcttcttctgcttgaacgcggcgtcattgcggacgaccgccgttgtttcaggaatctgtttcaaatattgcggataactggcaacaagaccagcaatcatttccgggacaatatcgcctggagcattgataatcttcttcatatttgcaactcccttctagttatcagtgtaacgcttgcagtgctaaaaatcaggtgggatgcaaataataacagaaggtatttgatcgtatggctgtaggctggcaaccagttttttcatgatgatcgcaaggtgtcaaaaatcgcctcgttaagtgtgaatccactcaacaaggcgattttcgggcaagcaattaatcggcgaaatcagtaacggtttcgatggtgtaattgccgctatttttaagtaattttgaaaccgggcagcgattttcaatttcgttggtaaacgtcttggccgtgtcaagatcaacacctttgaccataacctgagcgtgaaccaagaattgatactccgcgcgttcaccaatgaaggcaactttaactcggaccgcgcctgtatgcggcaagccgtgttccttttcaacggcttctaaggttgcttccagacaggtgcttaacgacaagcccaaaagttgttcagggttggtgccgggatgatcgttcaatggactgcttgtttgaactttaaggccgccgggaatatacgcgtgcccctcgagtccttcatcgttaattgcttcggttgtatacagtggatgttgccaacgttcatctgccattagttttgcctcctaaaaatgagagtgcgccaaccggatttctgggatggcacgcgttatggggtgcatatgctgttgcaacaactactgcttcaacagtaaattgcgtggtgaattgcacagcacatgttttaaagattcaacacattaacaattataagcgcttacaaggaatttgcaatttctgggggagaatgaacccaaacgagtattcgtatgatataacttttaaattgcttctaagcgttaaatgaccctttcgaaactagaccccagatgaaggatacgatgctatgactttttgcaagacaacaagtatttcgtttgaaattggtgtacgaacagagtatgcagcgtagaagaattctggacttgattttggctaataagttcctggctacagaactttggaattgaaattattttttgagtttcagttattgcagtaataaccctgactattgcaataactgagcatattgatcttttagatgacgataatccttaaacttttctatttcaagatgttggtggttgatgaatatgccaacatcagtaacccgtgcaagttccgctaaattgtgcgacgagacaatgacaagttttcctcttttacctaaatcaaatatagctttctgaacaatatcaagactagttggatcaagcccatttagcggttcatctaataaaataattggagtatcgactaataatacaagtgtaatttgaagtcgttgcttcatgcccatcgagtatgttcggatttttttatcaatgaatttagaaactcccaactttgccatcattgcttcaacgttactttgatctaaatcatgtactttagcgactaagtcaacgtaatcccgccccttcatcatgccgctaaatgaagaagcgtcatcaaaataggcaactgttttaaagacgttgcttcttgagttcttttcattattaatcaagatattaccgctggattgtttgactagtccgacaatcaaacggagaagagtagtttttccggttccattaggtgctaccagaccatagactcctgaatcatcaatgtgcatatttgcttgatcgaagacgcgcttatgtttgtattgaaaggttaagttctttatttctatcatactggtcatttagtattacctcctttgaagtttaataactagaagacctgaaaacaaaaacattataccaagacttagggtgatcaaaataacggatagcaaagaacctccattttgaaaaataaatccatcagagatcatagaaatatgcagagaagcaaaaggagaccaccatctgattggtagtagtgaggcaagaacgacaattatactgctaacaagtgtttggacaagcgcattacttatcagtgtttgcaaaaggctacttattgaaaagaaaaggaaaatattaatcattaataaagaaatatcggtcaaaactatttgccacaactgcataaaatttccgttccaatcaaatatcggatattctaagctacctagactcgcgaaggctgccgatataagaaggaaaaccgctgtgattaccaatgtcatgacaaaatatgacaatatattcagcaaaaagccgcctaaatatgccttttcctggctaatattaagcatttctaaccagtcatttccacagcctgaggattttttaaatccgatttgagcccaccagcctaagatcactaagccaaagatggtgctgaggacattaaaaactagttcgtggaagagatgttccaaaaagtaaaatccatgagtgtaaaatcttgtcgaaaattgcatcgaatactttttaaaagttaagtcatctcctccaaaagtcaactttgtgctttcattagtcagtaaacgtgctgggaaaaagggcgttaatttgttagacgctacaaggttaagttcattaattgtgttttgatattcgccagatgtatacatgtttgttatatcaatagagataggtgtaaaagcgtttttaattctggttccgagcgaggaagtcccgttattatttcttcttatggaaagtgcctctaagtattttcggttatattcatctggcccagacttgagcgcctgatattcgtactttatttgtgccctcaatgatgaatccctttttaccgccggagcctttagcttctcttcaatttgtgatcggtaagagttaacgtacttctcttgattctgtatttctatgaaaaataatgtaaataagatagctaaagtaatgaaaagaggccataaaaagggaaatgcgttttttaacaccttatgctgccatttaattaaaatcatttgacttccccctttggccgcttatcaatatactgattgatgctataattaataaaatggtaaacaatgtcaggactaacattgagctgacatctggtgtcacatgatcttgtataatataaaagggatttgtatttacttgtatttcggtgaagttccatgtcataaaaaaaccgaatccggtgcatatagcgaatgttactagagacaatattgggtttttaagcaggctcaacaataatctgtagatactttgtgtcaaccagcaaagcactatgagaatccaagtctccaaacaggtttctttgaatatcgagttccgaaaagagggccaataaacattccagtttagtgaagatgaggttgggaaaaggcctttactaaatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaaatagttttaaataaagtatagataaactgacaactaatatggcaattattatcggcaataaaagcgaggatgcaaacgaaatgagtggcagagaaatctgctttttatcattaagaatcatgaacgctctcgaacttccaaattcaactatgacgatttgaaggagagtaaggacatttattagtactaaaaaaggaaaagtctcgaaatttttcagaaaagaaactgctcctaagggatacaacaagctaaatttttcatcttcatatgggagaccctgttttatcagcgttgccactttataataattatttttaagtgctttttgtgactctcccaaaggccagaaactatatttctttagatatttacttccggactcgaagatgactttagtcttttgtaaatattcgtcggcatcgaatgattgcagactctgtttttgtaactgaagttcatctatcagttcaccaagatcatcaaaatgtcttctattttctggtagaacattcccttgtgagtcgagtagagtagtttgcgtttctttgattactgtaatattatgtgatattacattattttcacgcaaaaagaaggttgattgtgcgtccgaaaagctgaaaactgagattaaaaaaagtagtataggtacaatgatacataatacccagatacggcttgctaatgctgcctttacaaagaactttagcataatttataccactttccgataagacatgaaaggacacattctgttgaatgtgtccggggaatattaccagctatagatttgacccctataagctgcaacgtatccaccatcaacttgatgataaccagtgcggtttgccccatacgtcatgtaggggatatcgccaatgtgcaaatcacccacataaacaactggcggaaattcagtaaatgccattgaaaatgttacccatgtgccatcaggataaactttactttgaattgaagcaggactcgtaacatcttcatcccctcctcgtgtaaccaatgatatccgtgatggctagcatttttttcagaattgcagatttgaatcggaattttacaataagaaaattcgtctacaatggttctttttgcggtattaactggcgagtagtcaagttcttaaaacgatgatgggttgacttcagaggctctttttcccgcagcaaaggtattgtcaagtcgtggcataacatatcaaagacgacttctcacagggaagccgtcttcaatgattatagttttttcaacactattgatgaacagataaggaccttaagcattctttagattggtagtttacctgcaagtttgtccaatttcattagtttcaacactgaccttatttcgttgatctcagcgttcttagatgcttctttagatttggaagttaaggcctcatagtatttgcccaatagtctatagaaaaagaagactggggtgagcggcaaatgatttagataacttaagggcctattcatcattgaaatttcgttttttctgtaacaagtgtcaatgtagtttataaatatagttgataatgtgcttagcaactcgtcattaagcaaattttgcctattgtatttatgaagaagagcgttgattagaaaactaagctcatcgaattcatatagatcgattgtattggcgaataaagcaagcgttcttgcgttccaattatcttgactaaatagtatatcgcgactactcgttttagttgtctcatccagatctttgagactatctgttaaaatggcttgaataatttttcccagaatctcagtgttgtgctgcctatcttgcaccattggattctgcgataagccatcattaatcttttgaactgtcttaagatcatttgaaaaaaaggccgaatacagcctctgttcgattgatgccattgactcagattttttttgttggatcgatacttgtgacataaatttaggaacggatattttatttagttctaggatactaattagatctttagcattaatatcgttaatgtcattttctactttagagtaaaaagaggttgaaatgacacctgctgccatctgtttttgcgttagtcgcaatttgaggcgctcggcttttaataaagatccaatggtttgcattttaacaactccctcgtatatgtgaggcttaattagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaacccgatgaagtactgataggctggtgtatcacggatatcgtcgacaacttggcggtcggtcaggcctttcttcaacttgatcaacgttgcgccataaagcaatcgaaatggcttcgctgctcggccggtttttgaaggaaactgtaattggtatgcctcttcaagtttggcccatgggatcaattctgcatattgaacccactcgttgtccgggctgagcggtgttcccagagcgcttccaaaggattcaaatgacagttgcgttgctttttgacgataaaccatgatcaattcctccgataggtcagcgataagtgcaagggtaaatcccaaagcataggcatttcgggcaaataagggttgcacttattatacgccgaactattggtaaatcctattattaaagtacttttatagtttttcaccatccactaattagcaaagtcaaatgtcggaatgaaattggcttcagacaatgcggatctgatttagtcactgtgattaactctttaaacccagatttttgcgcagtgaattgcggtaagtggaagagcatgcggtttaacttaccattattgacttgagcgttatttattataaatgctcataaaactacgtgagcgatttatacactgagctatccccttagcgcgtcagaaatcaatttataagcaatgacgatcaaaatgcaaaaactaccaaggccgaagattaccgatatcgcaaggatcgcaccactgccaattttcgcataaagtaggccgagaaataaagctgccaagaatgttacaaattctataatccatagttttagcaaatgtatccaacctccagtgttactttgtaaacaagctgttctatgctatacggcatgaacagttgaaattgatcatggtgctaattttaaactagatcaccggtaatatgaatgacttctgaaacttgagttatttctgacgcgctcagacatgatcaaaagcggctacgtaaggcatttttctgcaattacaaaaatgtcttacgtagccgagtagttcacgatttcggatcagacttttgatccggttctgggtcattagcgcgttctggtgggcgttgagaaaaaccgatatcacgagtgatgagcgggtggccttgccagatgaggtgttccagcagcgccatggtggttttggcatcactgagcgcggtgtgggagggcaggtcgattccgagtgcttctttgtaatgttgcagtgacggggtgtgttttttgccgataccgaatgttttgcgcgccaacaccgcagcatcaaacgcttgaatggggtcaactttgatggctaggccggattgcagggcacgaagatcgttgcttaaggcgaacccgacaactaattcatgccgcagcagctgttgcagtgcagttttaacaagtggcagagattggccgtattttgccaataagtcgtcggtgatgccggtgattttaaccgagaatggcatgacgtgatggccggctggcagttgcgtgaaaatatcgaatgtctgatcaatccgatgttggcggacgcgcaataagctgatttcggttaagtcaagctgattgcgatcggcgacgaattcggtgtcgatgacgacatagtcaccgtgagcaaggcggtctatgacatcgcgctgggttgtcaacgctggctgatctgaggcaagctcggttactaaagtggggttaagttgtaatgatttagctgcacgacgctgggctgcttgaactaggggcatctcttcgcgggcgaattttgcagcaagccgcgccatcagttgatctgcttgaacttgccgctgatgttgtagtgagaccagcgattgatccgccgtgccaagggtaatatcaaatagccgcgcgagccagattgctgcatcagaagccggagcggtagtgacatacaccccgtttatatcggacagtgcgaatgccacttgcccgttttccgcccagttggttaaccccaaggcgagtagatgaacccaatcgcgaaaaggccgcatgaaggcaaacaactggcgctggcggtctaaccgatctagacgcttagccgcggcggacacagctgcggccaattgcaaggcgaggcttttgcgatgattgccaaagtctttgagcttaaacttgactggtaaaatggcactgcgcgggcgcaacatataacggagacggccaccttccgggaaccagcgggctagatcaaagctgacatcgccacgaggagagacctgattaacggtggccggctgtttagcagttggggtacgatgctggagaaccgccatcagttcgttgagtcgggtgcgaacctcggcggcgttgcgcggcttggtaatcggatcacgcagtaaatgattcagctgccggcgagcttgacgtggtgagtgatttgacttgcgatgtggtctggactgcgccatgatgacagcctcctttcttagcgaaattaaagctaagaacagtataccaagtgtggcggggatttacatttttggctcttgagtgatggttgagcagacacaatgaaagtacagattggttttgcgtatgttaaaacaaaaacagccatcttcgaactgaaagtgagtcgcggatggctgtttggattgtctcgtaaagtttaaatgtttgacgagtttgatcttactcaatgttcaatgtatcgcggtgtgtgcctgttgcaagaaacattaaaattaacgcttcagcatcgactttataaacgagaagccaatcaggagcaacatgcaatgctcgttcgccgctgtgagcaccctttaaagcatggtcgtgtaaagaagctaattttacacgatcttgacgctacaaagttgttgcctgtcaatatgcatgcagttaaccgtcaacatcactgtataaatccttcatcaaagcaccaacagtcttgaagctttttattcgccccgctttaacatctgcttctgcaaatcgaagctgatcggcgaatgacatttcaagtgtaaatggcaatgcaccggtgtcaccaatccgtttccaatacatgttaatagccgagaatctctctagtcccagacgattaagaacatggagagctcgttttctggttattgtgttaatccaattgcggatacgggattcttttgccatgatgattatctcctccgggttatattacatgaattgtcgccaatgagctaacatttttatctgactaaaaatctcccttgtattgaacccaaaattatgcgataactgttgtatggatatcaaacaatcagtcattaccgagaattttaaacaacggttgttctttgcgctgtctgatcccggtcgatataaaattgtccgcatgctttaccacgtgggccacgagatgggctgcaacgagttgaacgaacacgtggagattgacaaatcaacgatgtcatatcatttgcgaacacttcgagaaatcggcatgatcaccacgcgaacgcagggacggcaaaagtttgtcacgttgaatcgagaaaaaattgaagcagcgtttccgggattactggaaaggctttaaaaataagcaaatcaatgcttattttttagcggtaattgtttgatatttttaaaactataaaatgaactgggggctttttgcatgaaacatcgtcaactatctttacttttcttcttagtcatgtttgtgatcgggacggacactttcttagtttcaccgctgttaccgacactgacacgttattatggcattacgaccagcctttccgggtttattgtcagcgcctatgccattggatatatgctgtcagcactgttgatcggcccgatttcggatcgccatgatcgtaaaaagatcctggttggtggattagtcgtcttcaccgtggcgactgcgagttgtggattggcgaatacctttgcgtggatgttgatcacgcgctttgttgccggaattgccgctgcgactgccgggccacagatttgggctgcgatccctgttttattcccgcgtcagcaagtggttaaagtgatgggctatgcgaccgctggcttggcagtggcgcaaatcgttggcgtccctttaggcagttacttagcagtttggtcttggcggttcccgttctttttcgtcggagccattgcgttgatcctgacgcttttggttatgcgcctaatgcctagtttgaatgacgcaaaagccgcaccggcatccgagagtatttatcggcagctcatcggcaatcacccggttatgaagttgttagcggcgtacttattgttccaaacggccaatttctgcggctttgcgtttatcggtacgtggtttgctaaaagtttcaacttatccgttggcgcgattggcagctttattctgttaatcggcgttggtcagtttgtaggcagccttcttggcagtcggcttgtgacatggttaggtcaacctcacgcctttttacttgaatttatcttgtttatcatcggttatgtggtgctaccgtttgccaactcaccacttgcggccacgattattctggcgctcatttatactattggcggggctttgttgccgctgtttatgagcacgttacaggagcatgccggtacagctcgcagcacgatctcagcgttggccaatgcggtgatgtatttaggcgaagcaattggcggcgtcatcggtggcgttttaatcaagcagtttgccggtttttccggaatcgcaacgtttacggcagtggtcgcggtgttggcaatgctgttatatgcacagcagggatattttaagcagttacagacaagcagataacttaacttgcattggaaaataattcgtcaagcccggtttcgacatcattgttttacaaatcacgcgttgacaagttggcgttgttttaacctgacagagattgtataattacaaggtagaacatacgtttgtgtcttgagaggggaatgtcaattgccagctaataaacaaagatgcgcgtgggcggataccaccaatgatttaatgcgtcaatatcacgataccgaatggggacgcccgagccatgacaatcgtcacttgtttgagctgttgtcacttgaaattatgcaagcaggattgagctggcagaccgtattaaacaagcgggcagcatttaaggcggcgtttgctgatttcgattatcaacaagtcgcacaaatgacgccgcaaattcctatgcttttgaaaaatgatcaaattattcggaatcgaatgaaagtgacggcgatgatcaaaaatgccaatgccgttgagcagttagtggccaatggtacggattttgaccattatgtttggaattttgtcagtaaccaactcattcaacatcatattgagcggcatgaacaggtaccgaatacaaccgatttggccaaacggatgagtaagcagatgaagaaggatggctttgcgtttaccggtccggtggttgtgtattcgttcatgcaagcggcggggttggttaatgatcacgaaataggttgctttgtttatcagcagcttggccaataaccgggcattcagattttggattgacggaaccatgatttcacagccttcaaacggggagcgtatttgattaaaatacaataacccatttatactggtctaaaaccaaaaagaggtctgatcaatggaaacgacaatttgtaagattggagattcggttggcgtcatttttccacgagcattacaagctgaagttggcaaaaaatataagatttctaaagttaaggatacatttgtgctgacaccgctgcgatctgatttatttgccgctgccgctgattggcaaggattcagagatgctgtgactgatgaagaccgagcatgggatgagatagaggactaagcttacgtcatcctaaattcagtcacagcggcagcacttatccttaacagctcaagtaacgagagacgaaaagaacccactcgcaattttcagcgagtgggttctttaaatagtctttgattaaaaaattaaagtgcttcaggaaccatcttaactggcttgttgccaatccagccggtgatttccttgaaggtatcggtgatcgcatcggtgcctggcttgagcatcttacgagggtcaaagcccttgccttgttgatccttaccagcttcgatgtattcacgtgttgccttagcaaaggcaagttggcattcggtgttgatgttcaacttggaaatgcccatggtgatcgccttttgaacttgttcttgagggataccggaaccaccgtggagaacgagcggcatcttaacggcatcgttcaattcttgtaagcggtcgaagtgcagacctttccagttgtctggatattggccgtggatgttaccaatgccggctgccaggaagtcgatcccggtagctgccaaggtcttggcttcttcaacgtcagctaattcaccttcgccgacaacaccgtcttcttcaccgccgatggaaccaacttcagcttcaacggaaatgcccttggcgtgggccagcttaacgatttccttggtcttttccaagttatcttcaaagtcgaggtcgtggccgtcaaacataactgagttgtagccagcagcaatagcttccttggctgcttcatagttaccgtggtccaagtgaatcacaacaggaactgtgatgtccatggctttaacggcagcttcgatcatggtttggcaaaattcatagccacccatgtacttagcagcacccatggaagtctggatgataaccggaacgttcaattcttgagcgccggcgagaatggcacgagtccattccaagttgttggtgttgaaggcaccgatacagtagtgacctttatgtgcagcttttacaagctctgcagcgttaactaatggcatgtagatatcctcctacgaaatatacaattcacaactgttgtattctaccataaatgacaaaagaaaaggtcgagaaaatgatgagaacatgacggttttactgaccggtttgaaaggaaacggtcacgctgataacccatcgttaccgaagcccaattaaatttaccgtagtttcggaaaaaacgccattgattgactcggtattttcagaggttagaatctgcttactcaagccaactagccaacaatgaaaaagttcatgacaatgacggtgattagcgattgttacaggctaaaatgagatttttctcattttatattagatgaattgcggggtaacgtagtggatttcacaagctgatttaaaatgaccgacgcataaatcgctttctttagggggttgtgatgacaggatcgtcaaaaaataactgaataaaatagcttttcacaagcttgtagtgtccccacaaataagaccttgcttagaacgattgaccctggaaatcaaagcactaaggtaaaggtagtaacagattgataacaattgagttgttcacacgaataaattaaccaaaggagatcttgatatggcaacaaaagcagcggatcagttagtcagcgtcttgatggattggcaggttaagcatgtgtttggcttacctggtgactccattgacaccaccgtggatgctttacggcgccaacaagataagatcaagttcgttcaggtacgccacgaagaagtcgccgcactggctgctgcatcaacggctaagctgacaggtggcctcgggggttgcttgtcaatcggcggacccggcgcgattcatctattgaatggcctgtatgatgccaaaatggatcatgtccctgtactggcgttattagggcaagtcacaaccagtaacttaaatgaaggctttttccaggaagtcaacacgcctaagctattcgatgacgtggcggtttacaacaaaaccgtcatggcgtcggataatttaggccagatcgttgacacggctattcgcaccgcgttcacggaaaaaggcgttgcggtgttgacgattcccgacgacttgcctgatcaaaaggaaaccaccagttatcgcgacagtgcagcggcgtttgctttgaatgtaccggaagtggatcctaagcagttggatgatgtggcttcgcttttgcaaaagtcccagaaacctttagccttgattggtcgcggggcggaaaaagccggtgaagccgttcaaaaatttgtcgaaacgaatcacatcccgtttattcagaccatgccggcgaaaggaacggtggcagacgatcatccgaatagcctcggtaatgtcggcaagctcgggacgaagcctgcgtatgaagccatgaaggcaacagatctgctgttcatgatcgggaccaattatccatacaccccttatttaccagatacagggcaggctaagtgtgtccagattgatacgcagccggagaacttaggcaagcggtattcggttgatgttgccgtggacggcgatgtcggtgcctttttaaccgaactgaatgctaagggagctttgcgtgatgatgatcgcttcttgaaggcatgccggaagaatatggaaagttgggacaaatggatggccgaaaaacggttactggatacgaaccctgcctcaccggaagccgtctttgcgacaattgaccaaacggcacctaaagatgcggtttactcgattgatgtcggcacgtcaacgtcttggggtgcccgttttctcaatgtccagccaacgcagaagtatacgatttctgcgtggttagggacgatgggctgcgggttgcctggtgcgattgcgggtgccgaggcatttccaaagcggcaaaatatcagcgtggccggtgacggtgcttttgccatggtcatgcaggattttgtcacggcggtcaagtataagctgccaatcatcatggtggttttgaataatcaaaagcttgccttcattgaatacgaacaacaaagcgccggtcagttgaattatgaaattgatttggccgacatggattacgccaaaattgccgaggccgctggtggcgttggctataccgcacacagtaatgctgaatttaaagaggcactcaccaaagcctatcaagaaacagacaagccggttttgatcaatacctatgttcaagacgacgcgccactaccaggaaaaattgttggtgaagaagcgaaaggctacatgaagtatggctcccagtatcttgaaaattattggaagattccttccatgccgccattgaaagatattatgcggcaattcttctaaaatttatgggagtgcaacaatgaaaacaggcacggcttaagtttgaaagtgacttaagccgtgcctgtttttgtttggagtggttgacgagcaaataacgggaatccggcagctgaacttggtctgcggattatgctagctcgtgcatgggttattacatgctaacggtattaacacgccgcagcctttaacatcacaattgtgggtcaaaaattacaagctcagcggccaaagattgttgccaagctgtttaaacgagaagactttatcccagagtgctttttcttcaacagtaaacgaaaagcgatcactcaacttaacggaaggcgcagaattgaaaaaagattggagcgcgccggtgaaggcagttccgtggctgtttttcagctcttttaaacttttggcaacgtatctcgccgtctcggaactcggatggttgtggctcagctttacgctcagttgttccatactggcgatgacttcttcgggttgaactttcatgaggcgatcctcctgcttttcaatagaatacgcttacattataattctaaggcaagttggatgcaatgcattttacttctaaaacagatgggaatgccgatgtttattgatttattttactctttatgctaaatattacacttttaattaataaataaactaatatcagcttgctatcttggcgtaaattattgcctttaaactataacgatgtgcgccagttggccatctcctcttgtcattttttgagtgtctcaacgccgggcgacatgttggtcagcgtaatctgtgctaattgcttttcaaatgaaacatcaaaaaacgcccagtaaccgaaaatatgaccattgtgacttaaccagtgctgtgttcgggatttcatccaacccatgccgtaaaagtcgtgggtcagcgtcagtgcctcatcccacgcggattccggcaaaatgcggcgctgtaaaacggctcgcgcccagatggccaagtctgcgagtgaactcaccaccgcgccatctccaccttggtagtggccgcggccaagggcgactggtttgccatcagtaaagtccaaatcatcgtaactattggcatcagcatgttgcgtacccagccgagttttcgtcattgccagcggcttaaagaagtgttagttgagaaaatcgctcagcggcttgttcgcaacctgcgtaataatgtgtcctaggagatagtagttactattggaataggcacctttttcatctggcgcaaagtcgaggggatgttgattgagcaattcgataatctgctgaagggcgtcactgccgttgagatcttctaggatgggataacttaagtgcgattcgctcgcatcgggcatttttttggcatagtcggccagcagtagctccgtataatccggaatcccactcgccatatgtagcatctgacgcaaggtgatttgtttggcgaaacgatattcaggcaagtagtccgacagcggtgcatcgatattcagttttcccgcggcatttagtaataagatactgttggccgtgaactgtttgctcagtgagcctaagccgctggtggtgttgagcgtaaacggctgacgcttggcaaaatcagccatgccgttttgccagtaagacagcatacggtgagtgtcgaccaaaatagcggcgccgtttagttgatactttttattaattagttgataaccttgaagattatgcatgcagattcctcctcgtctggatacttgaacgtataaagaaacaagatcttcctagctcatgaagatactttctactctaggttaaccgccctctttggacaaggttaagaaatgagaaagtatagtttacatctatgtctgatcgccgttacgacttgccatatgaccctataccaaaatttgctacatagctagaaatatctgctgatctctgatgcttacaccccaacaaatttaacaaagtcccattattttgaagtttttacaggaaacgaacataataagccaatgaaaatgtgagcaaagactcaggaggtagacgactgttcaagagcatccattataatcgcataagtaatataatatatggtaaaaagcattgacaaaaaatggaagcgcatttatacttgcgaaaaccaaatagaagaggggataactattgaaattggaagcaaaagtcttctgcaaatatcatcggaatgctaattggcgcacacaaaaagtttgtgcgattgctggttagtgctatgcccaatgagtggaaaggtgattggaaggattatttggccacaggaatatcattgttaatagcgggcacaattgtgattttcttgattttgccatttcaattttttcaacaacatttgttaattaccggtattctttttgccataatatacgttataatttttttcttggtatctttactattaaagaaagaggaacgtattaggctcagcagtttttttaaaaaatctaaactgtaattaacaacgtaaccatatgacaaagacgtacttacattttccgattttggtgatgcaagcacgtcttttattttttgctaatgtgcaaagaaactagaaacaattttgaagataagacattgccttctataaatgaacttcaacgcccaatcccggccgatcagacaaggttaaggtttctccgtctgcttcaaatccgccagtgagccaatcggtttcttctagcaacatgaagctatcaacatcgccgtaacggacattggcgtgggctgcaataaaatgggcggaggcagcggttcctaggcgggtttcggcgttgcagccaaccatgcacccaatcccggccgctgcggcgatggcattgatagcgttggcgcctgcaaaaccgcctgacttggctaatttaatattgatcaggtcagctgccccgagtttaaccgccgcactggcatcatgtgcgttgtgaacactttcatcaagcatcaacggcaccgcgagttcttggcgaagtgctggggcttccatgagttgccaatccggtaatggttgttcgagggcgatgaggttgggaagttgcaactgcgccatgatgcgacgggtttgagcggcggcccaggcttgattggcatcaactttgatggaaacgttagggccgactgctgcgctgaccgctttgatggccgcaatatcggcaagttcatcgttaccggcctttaactttaaggcggtgaatccagcgtgtacatattgttgggctgttgctgccatttcttcagctgagccgatgggaatcgtgatatcggtggtaatagtgttgcggtcgccgccgaacaattgccaaagcggcatgccagctgactttcctaaaatatcgctgcaggcaacgtcaatcccgcattttaaggcagtgtgaccggccatcaccgcatccatccgcgcatggacttgttcgagattgcgcggatcagcacccacaagtgttgcggcaaatgttggtagagcagcttgttcggtttcattcgtttcgccgttgaccggtgcatacggtgatgcctcgccaaagccggtcatgccagtatccgtttcaattttaatgatgagggtcgtgatcgcactcaattctcctaaggcaagtttgaacggggttttgagtttaatcggccggggatgagcggtaatcgcagtaatttgcatggctgcctcctattgataagtgttgagccaacggtagcatgcatcgtcatgattttcaaactaaaatatcattggaatgtaacccgaatcaaatttttgatggacagttttctagccgtgcggttgcgtcaccgcgacaggactgcgatgatggcaataagcagacaacgatggaggcaaaacatgacagctatttatgatgatcccgattttttcaaggcttatagtcaaatggatcgctcgaaaaagggcttagccggcgctggcgagtggcacgagttgaaaacggtgctgccggactttaccggtaaacgggtacttgatctggggtgtggctatggatggcactgtcgatacgccgctgaacatggggccaaaacggtgctaggaattgatacttccgccaaaatgctggccgaagccgcgacgatgacccacgatcaacacatcgtttatcaacaaatggatatgcaggacattgatcaattaccaggatcttttgatgtcatcttaagttcactggccattcattacattgctgattatgccgggctggttcaaaaaatcagcgccaaattacctctgggcggccagtttatcatgtcggtggaacatccggtttttacagctcaaggtgacgagacatggatcaaagatgatcgcgggcacaacctttattggccggtagatcgatattttgcggaaggtcagcgtgaaaccgagtttttagatcaccgtattcaaaaatatcaccggacgttgacaacttatttgaatacgctgcttgatcatcacttacgcttggatcgtgtgattgaaccgacgcccactgccgcgatggtgcgcgatattcccggtatggctgacgagctgcggcgaccgatgatgttaattgtggctacgactaaggtgaggtgaagagcggcgttttacctagcccataaaatgatgcaggtagtagtgagtcacacgttctgatatattagttttaacaacgagctaatctcactggaggtattttgatgagcaaaacaacgcgatgcacctatctgcttttgggcgcagtcttacacgtttggatactgaataaattattgaacccctttttgggccaacagtatcaagcgacatactccctgctgttctgcgtattgtttgttatctctgcgctattgttgggtagtctgttggccagtggcgacaagctgctgagccgcgctggttgttcatttgttcttgaagtgttaaccactggaagcattgagcttatgtactggaagaattttttggagatcatgctctacgcggtacctatcctgctgattcaggggttggttttactctttgcggccctattacgggaaaaacacgccaaagtgatgcattaaaagcccaacgaaacgatgataaagcgatgcctaaggattgttgtgggtgaaacgacggcgtatactctgggatattcttatttaaaaatgtgcgcgatttggccagtgttttggtaccggcagtcgcgtttaaggagtgtacgcatgaaacctagaattggtattcccaccgatgaactcattgaaattaatcctatcatgccgaacaatcatccggcttatgcaccacatgatgtcaaagaggctttcatcaaactaggcgcgataccgttgatcatcgcttttccggatgatgtcagcaaggttgaccagctggcacaagattatgtgcagctgattgacggcctgatgttgccaggtggaccggatgtggacccaacattttacggggaagagccacatccgaagatcgggatgacgctgtaccaaaaagatcgttttgaaattgccttgattaaggcggcgttggctgcggacaagccgattttcggcatttgccgtgggattcagattatgaacgtggcgatgggcgggacgctgtatcaggatcttgagagtcagtatccggaattgaaaatccaacacccacaagccacactggggcaatttgcgacccaccatgttgaattgaccgctggcagcaagttggccaagctttacggacggtcaacgattaaagttaactcgcgccaccaccaagctgttaaagcggtgggaaagggattgaaagtgacggcggttgcaccggatggcgtggttgaaggcatggagtccacggataccgatctcttcctcggcgttcaatggcatccggaaaacatgtggcaacaggaggatccgcagcagttagttgtctttcaggactttctggatcgaatcgctgctcatcgcaagtaaatcagctggccagctagcacacgcatcatgatgaaaattgaatgtaaaaagccgtctccagtttttcaggatgacggctttttacattcaattgcttattactgaacgatatattcgaggctagtaatcttaccagtctgtcttttcctcagctactggtttgatattatcgagatcaccggtttcttgaagcagggaactaaaatcaacgtgatcaaacatgccattgaaccatggattgtcactcttttttcgtacatagatgagcttgctggcatcagcacttgccatgagttcgaacaattcgccttcatgaacagacagattgctgggaatagttaaaacgagctgattcccgtgtttttgggctttgaagacaccaaactggtttagtttatttgtcatgaacttatcctccgcaaattgtttttgagcaagcaagtctggggtgctggcggtctagtcgttacatggtacaaaaattatagcatgaagccagctgatgtggataagcgctgactttaatttagaggcttgtgatattgggctcaatactatttttaaatttgtcagcgcatataaagcaattttcagaaattctttcatttcaccaataatcatgtaagattgaaaccgagtgatgttacgtaacgggtgttgtttaagacggcgagcatgatgaaaaggggctgaggttagcaatgaatgaagaagctgtgattgagcaattgacagagaagcaaaccgagctgatcgagtttctgtatgtggattataacggcctgacacgaggaaaggtgatcccgcttgcgagtttaaaagctaaactggcagatggcattggcttgaccaaggcaaccttgaatgtcagcgagcgcgatacgattttaccggtgcaggatatgacgccaatcggggagttgcggctggttggcgatccggcgtcggctcatgtgctgccatacatgccgcaagtagccactttaatgggtgacatttataacctcgataaaacgccttatgcatcagatccgcggtcgatattgaagcgtgtcgttgagcagcttgcagatgctgggttcagtgtgaaaatgacttatgaaaacgagtttgagctatttaccggcgacaaggatcatcgggagcctgcgatgccgcgggttgctttttcaactgagtcgatggactttgcttatccttttattctcaaagcgattaatcagcttcaacaagtcgggattatgccgaatgcgtattatccggaaggcgggattggtcagcatgaattgagcatgttgccgcaagatccggtaacggccgcggataatgaggtgatttataagcggattatcaaaaatacggctaagaatttcgatctctatgcatcctttgcgcccaaaccgcttgtggattcggctggctctggagcgcatattcacttttcgttgtggcaagaccaaaaagatgctttttttgatgacgatgcgccgatgcatttgtcgcagaccggtcagtattttgtgggtggcattttgaaacacatccaaggcttgctggcattaacctgtccgtcagtcaattcgtatcaacgcctcgccccgggacattggagtagtgcttatgcgacatatggtcaggataatcgcgaagccgccgtgcgaatcccgtcaacggcctggagcgatccagccagctcaatgaacattgaactaaaagcgagtgacgccactgccaatccatacttagcgtttgcagggctgttagcggctgggcttgatggcatcacccaccaactacaacccggtgactattgcgatgttgatccggccagtcttagcgatgcggaacgcgcggcaaaaggtatccagcgcttgccgcgaacattaggccaagcagttgatgcatttgtagcggatccgctatttcagaatttgttcggcgctcagctggtagatgcttatgcaaaaatcaagcgtgaagatgaccactattatggcaagttggaactggaaaagattgcggcattgcatcgggaattgtactgattgtaggaagattttaagcaggcgctgatccgtacgatttcatttacccgcgccggctcgcgctcaccataacgcgttcaccggcgcagaagtctgcgtgtaaggaccttggtcgcaatgaccaaacccgggccatcacgcccaaggccacttacactccgacttctacccgcgcgggttcacgctcactttctttgaggaggtttcattttggacgacttaacggaatttgtcgaccaagtcccattgttggaccatcactgtcactttttgattaatggcaaagtgccgaatcgggatgaacgattggcacaggtttcgactgaagcagataacgattatcccttagccgacaccaaaaaccgccttgcttatcatggttttttggcgttagcaaagcagtttgcccttgatgccaagcacccgttagcagcgatgaatgatccggggtatgcaacctataatcagcgcatttttagccattatcattttcaggagttgttgatcgatactggatttgtgccggatgatgcgattttggatttaaatgaaaccgctaaattgaccggggttccggttaaagccatttatcggctggagacgcatgctgaagcgctgatgttgcagcatgataactttgctgcgtggtggcaggcgttgcgggatgatattcgccaagctaaagaacatggctttgtcgggtttaagtcgattgcggcttaccgcgtgggcttgcacattgagccggttaatctgatggaggcggcagcagggtttgatacctggaaacagtctggtgaaacccggctgacgtcaaagccgttgattgattacatcttgtaccacgcggcgccgctaatcatcgcccaagacctgccacttcagtttcatgttggctatggcgacgcggatacggacatgtatctaggtaacccgctgttgatgcgcgactttttaaatgtgtttgcgaaaaaagggcttaaagtcgttttattgcattgttacccgtatcagcgggaggccggttatctcgccagtgtctttccaaatctgtattttgatatttcgttgttggataatcttggtcccagtggcgtgcagcgggtgttcaatgaggcagttgaactggcgccatacactcggatactatttgcgtctgatgcgagcacgtatccggaaatgtacggcttagcggcgcagcaatttaagcaggcactcgtcgcgcacttttcaacgttgccatttgtcgatctagcccagaaaaaagcgtggatcaacgccatctgctgggaaaccgcggctaagctctaccaccaagaggatgagttcaagcccgcagatccgcaccgctaaaagcgagtttgctaatagaggagaaacaaacccattatggaaaagcgtaaaaaattaaccttacttgaggtctttggtctttcgatcgccatggtcgctcccactggcgccatgtcgtttaacaccgcaagtgctgccgccaacgccgggatcaacatgccgattgctttcttgcttggcggcattggtgtcttgtttgtggccatttcgtttgttgagctaggtaagcgcatccctggcgatggttcggcatatgcctacaatgccaaagcgcttggcgaaaaagccggcttcatttccggctggttgttggtgttgacctacgtgacctttgtgttcagttccggtgccattgtcggaaactttgccaatgtctttctgagtcacttaggcatccatttaccagtcaatttatacaatattatcgtcctgttgttagggggctggctcagtcataaaggcattgagttttccactcgtttgaccttggtgctggaattgttggcagttttagtgttgagtgtgttgaccgtcgtgattattttctccggcggtcgcagcggcaattcggtgcagccgttgatccctcaaccccacatggctaccggcttaggcatggggatggtgtttgctctgatgtcatttgctgggtttgaaggttcagcaaccattgccccgcgcgctacgaacccacgcaaggcgatcagtattgcgctgctgggggccgtaagttttgcggcgattttctatttcttggttagttacgcggaagtcatcggttttggctcggcacacattggcgatcttgccaaaagtaccgcgccaatgaactttctggcgacccattatctcggcaccaacgcggcaatctttatggactttgccgccatggtgagctattttgcctgttactttggtgcacttaatgctggagccttcatgctggaagcacttgggaaaagtgggtatctgcatccttggctggcggaagaaaccggggacaagcagacgccgacgcatgcacttgatagcatcacggggctggcgttgattgtgtatgtcatttttgcaatcggcttgggcgttagtgccagtgatatgtacaactggtttggtacgattgggatgctgggcttgctgacagtgtatgtgctggtgaatattggcgcgattgtttatttccgcaaagataaagggcgctcaatgttcaaacatgtgcttgcgcctgtcattgggattctggttctcatctatccgatctacaccagtctttggcccattccggcatttccaatgaacacttttccgtacattgcaatcgcctggttcctcatcggcctctgggtggcagcaaaaaggcgtaaggtcacaacgcgattagaagatttttaaatcattcctgaatccatcaaaaaaagcctgtcatcatcgcgatgcaggcgttttttgatcccatattgggtgtctaaactagaaacattttcaaaatcgtcagcggttttagtctgtccctgcgactttttcatgggccgtgccggttttgacgtatttttccgtgccatcagcgacggcctggcgataataatgctgcttgtattcaatcgtgttaagggtttggtgcagttgctgcatttgattttcaacggactcatgaagatgattgaaaaagtccagccgcttttccagtgtcgtgtcgccttccagcgtccactgcatgaaggtgcggatgtctttaatcgacatgccagcagttttgagacagttgatcatttccagcgcgccgagattgtggtcgtcaaaacagcgaaccccggcaggatctttcttgagatcgggaatgaggccttctttatcatagtagcgaatagtggggacggagagatgcgtgatggcggcgacttcgccaatcgaataagatacggacatatgaacctccaatggtgatgactaaagataatttaaaaaacagttgccctaaagttgactttagggactaggctgagtgtagcacttatcaaaacaagtgcaaaaaagttaatcatgctagggtgctttttcaattcgttgaaaacacccggcgaaagtcaaaagagggatgaaaacttgttagaagaaacgtatctattagccaatggggtaaagattcctaaaatcggttttggcacttggatgattgcagacaatgccgctgcggcaacggctgttcatgaggcgattgacgctggttatcgacatatcgatacagccgaagcgtatggcaatgaagtcggcgtgggcgaaggcgtgcgggcagccggtattgcgcggcaggacattttcgtcaacaccaagctggccgcagagatcaaggaacacgatgcagcagttaaagcaattgacgagtcgctgcaaaaactgaatttggattatatcgacatgatgatcattcacgcaccgaagccatgggcaaaatatgatgagcctgatcgttactttgaaggcaatctggaagcatggcgggcgctggaagaagcatataaagctggcaaactgcgggcgatcggtgtgtctaattttgatcccaccgatctcaagaatctgttggatcatgccgaaattgcaccaatggttgaccaagtgttagcacacattacccagacgccgtttaaaacgattgattttgccaaacaacatcacattctggttgaggcatattcaccgtttggacatggtgaaatgttcaaaaatcaggcaattcagcagatggcggaaaagtatcacgtttcagtggcacaattagggatgcgatatttattgcaactaggcctgttaccgctgccgaagacggtcaaaccggaacatatgaaggcgaatgccgagattgactttgagatcaatgaaaccgacatgtcaacgcttgaacacatgaagccattgacagactatggtcagtatcagtctttcccggtttatagtgatcggttaagttgagggcagggcattgattgcgtacaggtcaagatactgagacataattctatctcaggatgtgatgcacactaaaatccgaatactatagctgagaaagtagctaaagtagttccgtgtcgtgccaaactccgcactctccggccagatggggctggaacgctgtgacggcgcttggagcctgcaagcccggcagtctccaagtcgcctaacaacatcagcgacaaaacccggtcgctgtgttgttccacggctgagccccatcaggcctacgattgctccgctttggcactgggagcattaaagctcatttatactaataagaaaaagtcaaaacgcgtactactttctgaaaaaatcagaaatagtacgcgctttatattggagcggtgaattatggcccagcctcttgttggtcaactttagacgcatacactaactcttgtgaagttttaaatactgtttcacccgcaatgcttagcgatttggtcctgctttaatcacccttaggcgtctatatgccagcaattatgcccacggtccggcaaccacaatcttaccgatcatgtgtccggattcaacgagtgcatgtgcctgacgtaaatttgtggcattgagcggctgtagtgttttggttaaggtgcactgcaacgtacccttgtcgagaagcgcggcaacttgatcaagaatggcaccttgcgaatctagttcatagccataccaagactttgagaacatccactcccacacaaatgtggcccgcttcttagtgagtttctgcaagttgatgccgtggcgattttcggtaatagccgcgacccaaccatcaggacgaatcatggtggcgatctcggaccagtgttcgtctagatgcgacagattaaggatataatcgacatttttaaacccggctgcctttagctgcggtggtaatggcttgcggtggtttaaaacgtgatcagcaccatgatcctgtacccatttttgtgattcgggacgtgaagcggttgccagaacctgcagaccggccagatgcgctaactgtgtcgccatggaaccgacaccgccggaaccgttgataattaagatcgtatgatgccgattttctgcagttgcattcagggaaatgtgtaacttttcaaacaacgcttcccatgcggtgagactggttagtggcatggcggctgcttgggcatcgttcaggttcttcggcgcgtgaccgacaatgcgttcatcgactaactgatattcggcatcgcttccggagcgtttataactaccagcgtagaagacccgatcaccaactctaaagcgcgtgacatcttgacccacagcattgacggtaccaacagcatcccatcccaacactttaggctgagccaactgcgcgtgccctgctcctcgtgtacctgtgtcaacaggattaacagacacagcaagaacattcactagaaggtcgtgaccagtgggggttggcttagaaagggtcagatcttctaaactacgagcatcttgaatgggtaaatgttgcgtaaaaccaattgctttcattgaagtagcttcctttcgctaagtttcaccttgtatgttagcgggcatgttctaaaatagtaagtgagtaaattgtaagtaacttaaaaaaggaagtcctatgatgtcaggcgaactttatgattgtgcggctgggtgtccagttcaaaatacagttgacattatttcaggtaaatggaaaagtgtgatcctataccatctttttcagggtgacgcgacacggttcagtacgcttaataaagccatcccatcagtaactgaacgaatgttggcattacaattagcacagctagaagcggatcatgtcattactaaaaagccaggtgacgccgatggacgagccacagaatacggactaacagaattcgggcagacactggcacctgtgatccaagcaatggcaacttggggcgaggcttatcaagcacgacaaaaagcgaccgcctgattggacatattgaagatgaacattaaaaagcatcgttggaatttttgagtggttcccaacgatgctttttatgttataaatacgcctgatagaacaggaaaaccgcaagcccaagtgcaaagatgccgacagcagttttaataatgcgagatgggatcaagcgaacaatgaccggtccgagaaaaccacctgcaaataaaccgatgcagactgggattagaacaccccaagcaattggcatggagaagataaacatgatggatgtcaccagattattcaccagtgaggcaaggttgcgcatggcattgtaggtggcataagggccttcaacaagtcgcgaaagtacggccaccatcaacagtccggcaccggcaccaaaatagccaacataaataccgactaacatcaccagcacatagccaaaccaccgcaagtgctgacgcgtagaactgttactgcttgcgggtttgggtggcattagaatcaagacgccagccaaaaaaatgataaacgggacgactcgtttgaatcccgcattggaactatgaatcaaaataagggctccaaaaacgccgccaatggtattaagcaacgtaatgacaagcgcctgatgccagtgaccttttagttcgtggcgagaagcagcaaccgcagatgagccgctaaataaaagtccaattgtattcgtagcgttagcggtaatcggcgccacgccaactgacaatagcaccggataaagcgtgagtgccgccatcccgacaataccgttgagaatgccggccagtagactcatgcctagtaagaaaaggatggtttcgattgtcatggattcgcctccttttgctttagcagagattatatatctttgataccagaaattcgttaatagtgcatcttttacacatctgaaaaggtgattcaattgatgttagtgtgcggtcgttttgcatgataagcaaaataattgaatgatacggacttcatgacataatagatggaacccaacttacggttaaattgagtaaaacgcattgacgtctgaggagcttttatgactaagaaagtttaccgccttctcatcccaaccctaacctttttctacctatggcttgccttaggtggccttgatcaagctgcaaaactctggcttaaactggtcatcatcgcaatcggggcctttttaagtctgctttggattcgaatggtacggttgccgccttttcgtgaggtgcggcacttgtggcatcagattgagacgctgcagtttatgattgtttctgatccgaagaaccggctagatttgttgaagcggcgcgtttttgccgatcaggcgcgtcattttcgcgggttggccgtttatagttatgtcttgagtatgctgtcagggctgattttagatgggctgggatttgtgcgggtcagtgattttgtggtgacggtgggatggacattagcgttgatggtgctcatcacggtgtatattattggcgccattcaggcatttgccacgcacttaattcgaacctttgtgagtttgcagctgtttgccccgttggctttgctgattggcctgaatataaccggaatcatgcctgacttcagtgcttttcgcgattatattctatattacctgctgttgagcatcacgatttctgcggtgatgattgtgatggtgccgaattatcagttgcgggtgttgacgaattatattcctgcgattaatgcgacgagcacggtgatcatttttctactggcggagtttggcaatacggcgatggcaggcattgcgcatcagattagtcacgggcttgatttatcgccgacactgacggctagtttgtttggtccgaaaatgattgcggcgattcgcgaattgctaacgctgatcagtattgtgtttctcatcagcggcaacgttatttccgcggtgatgacgcattatcgagtgaagagtgaaaatcaattgaagcaagtgctggctgacatcacgcttccgatttcgtcaacggattatcaagggttgcgatcaattgtttatcacggattagcttataatgcgttgttgattattggtcggcgtgatctttatcaggctattcgcacttatgaacagcagcatggcctggagccgcctgcagaggaagcagcgcaatccaaacgtcactggtttgaatggttcaaacgacattagccttggcagacaccttgggtaaaatcacattcgttttttaaattagttttgccatttaggcggtataggcaaaaatggtctgctatacttagaaaaaatctttggattgctaagaaggtgagcccatgaaacaactgcaaattgcacatttggataaggcgtttgatcaacaggttttgtttaaagatgctaactatacgtttaaacaaggaaaaatctatggcttgctagggcgcaacggttcaggaaagtcgactttatttaacatgattgtgcgtaacttgccgcatgatcatggcacgatcgcaattgatgccgatgatggtcaaggattgatcacggattatgcggacacatcggtgggcatggtttatacccaaccgcatttaccggcgtttatgaccggggtggagtttgtggattattttatagcgattaatcggcagcgccttgagcaaacccacacgagcgttaaagcggcggatttcttttcattggcggggttgtcgcaggcagatgccaataagttgttgcgcgattattccgaggggatgcgcaataagttgcagattgtggtgtcgttgatgcttaagccgcccgtattattgttagacgagccgctgacgacagtggatgtggtggcggctcatgaaatgcagcagatgattgtcgcgatgaaggccgactcggtggttgttttctcgacccatattatgcagctagcacaggccatttgtgacgcggtggtgttgctgcatgataaaaagctgagcgaactggagggcctggatattcacagtcaggaatttgaagaggctgtgattgcgcgtttaagtgatgaggtgcaggcagatgcgtgatgcttggcgatattactggtttcaggcgcaggtcaatacaacaacgatggtgaatgggttcatttacttcttgcggcgaattccgtttctgggtaaaaagatcccgacaaaatggtaccggccaagtgcgttgaaaacgatcatggcaattgcagttaactttttcacgattttgctaaaaccggtgacaacgcttttgctgatcgggctagcatttttggttggtagtgcgtatcacgattatgtgcatccactggcaaccgatctttcacttcgcgtcatgatcgcggtactggtttatctggtgggttttctcatgtttcgcggcttggtattccgcaatctgccgctgagtctcaagtcggttaaactaggggattattttgccttggatcggccggcactggtgcgcgggttgatgctgatggatcaaatcagcggcgttgtacttgggccactactgcctatgtttgcgctcgccttgttgacgcagcatatgtggctgtttttggttggactgccgattgccattattgggtggttatggccgagtttcattccacggctgctgtgggcacactggcggctgggattgctggtgcagattgggtattggctgagtttgctggggctacccattggcttagtagtaaccggaaaattagccgcctttacgtttggcgttttttcgccgctgggctttctgattgcatgggctagtgtggtgctgattgggtggtacatttaccgtttttcgaatgataattcgttaatcatggcctccattcagtctgcagtgcgggcgttaaatcttgttgcttcagccaaaaagcagcaacttctagcggcaggaactgcaatgcaaaagaaactgacgctggataccaccgtggccctcaagtctgaaaaccgttccggcagtaattatctcaatgccttgttgtttgcccgttatcgtcgccagctatggaaaaagttgcggacccgtctgctgtgggttattggacttggcggtgggcttttgatcgcattgaaacttttcgctgtccataatttaggcgatctgacgccgatttatggtggtattttctttttgatgtatttgacctcgctgggtggccaaatcgttcaactgttatttgttaattgtgacgcggcaatgttgtattatcctttttaccgccagcctaagaccattttagccggattcttttatcggttttggcacattgttcaatacaatgcagtgactgggttcacggttttcctgctgatttttgcactgcagttaatcgcaccggtagccgatcaggtcaacttttatctggtgttgttgctggagatctgtggtttggtgttgttcttttcgtttcatgatctctttatttattatctgatgcagccatttacggatgatatggatgttgtatcgccgctgtaccgcttcttgtcctggggaatgtattgggtggcttggatttttacacaagttcatttttacggctatggttatgccatcctcattggaacgatgacgctgctttatgtcgggatcggtaccgcggtgatttaccgagtggcacctaagactttccggattcggtattaatctggccgcgtttagagtggaatttaatgttagttcatgagcactgccagcagctggcagtgcttttttaatatcacctagcagatgccttgttgcaagcggttgcggcaacaggtagagttgaattaggaaacacttattttgcaatgaatcataatcgatataagtgcggagctaataggcttggggtaatggagggtgaaggcatgaagaccaaggtactggcggtggatgatgatactgctattttggcaatgttaaagcgatactttgcgtggcggctaccggagtttcgattactgacagcagatgcagggcaagcagccttgagtcaattggcgcagcagcccgacttgattttgctggatgttaatttaccggatattgatggctttaccttaaccagtcgaattcgtgcgatcacttctgtccccattatctttttaaccgcacgtattaccgatcaggataaggtgcaggggttaggcgcaggcggtgatgattatgtgaccaagccatttagtctgacggaattaggtgcacgcatcaaggcacatgtcagacgtgcccatcagccggacaaacaggcgcagattgccgtttttggacggatcatgattgattatcatgcgcatcaggtctcggtggatacgacttgcctaaaacttgaaaataagcaatatcaactgattgaatggctgagcctgaatccggggcaggtgtttagccgcgagcagttgtatgaaaagatttggggctacgatgcacaaggggatgagcgggtgatcaccgagcacattcgccgcattcgcaagctctttgatgcctgtcaggtaacatcgcccatcgtaacggtttggggagtgggatataaatggcaaaattaaaagcacactttatgaagctatcgattaaaaaagcacttttacagatgattctgctgggaacgattgtcgccggtatcatgatgttgctatttttacaagtctggcatttcttgatgtttcacttgacgacagctttagcgactcactggtttttaggcggtgtcggtttgtattttggcggagcgattattggtagcttcgccgttttatatgcggttatgaatgcaatggcgcggatggtttatcggcttaagtttgcaccgccgttagcccagttaaaggcgggggtggcacatattcaggctcaggatctggattttgaactgcatgccaagacaaccgatgaactggggcaattggtgggcgcatttgaagcgatgcgccaagcccttcgtcaagcacttgaagaagcatggcagttggttgaggatcaaaaacaggtgaatgcggcttttgcccatgacctgcgaacgccattgacggttttgcaaggcaacctggaacttttgaccatggcggataaggatgagcagccggatcaggcactcttggctgagatgcaccagcagttggatcggatgacggcttttatccaaacgatgagtcatctttccgcgcttcaaaaccgtcagctaaccggtgaggcgatgacgccggccaccttggaacaacaacttaaagaagaagccagcaaacttgttccggccaccaagacggttacttggaaggtcgagaaccagctgacaacaaacgagtcgcttgcaattgcaccagatgtggtacttgaagttttcgataatcaactgaccaatgcttgtcggtttgccgctgagcaggtggcgattcacttaaccgcaacggcaaacgggttgacgataaaagttgataatgatggtccgccgttgacgccgggtgaacaagctaaagccaagttgccgtatttttccagtgatcgtcaagcccaacatctcggggtcggtatgtacatctgtacgcaattatgcgcggcgcatcggggtcattttacaattgccaatcaaccagatacccaaggcgtcagcaccattgccgaatttggttttttaacgcctgcctccagctcgactgattgatccgattttaggtaaattggttgagttgtcagaaaattgtcatttacttgttacagtctgcttatcaacatgatgcgtctgccaatttagaaattgcaggtgagaaaaaacgggtgcctttactgcacgcggttctcacagcgcggttttgaacaaactggctcgcttcatggataaggaggctttttttgatgacaacgattcagattgagcagttagtgaagcaatatcgtggccgacaacagccggctttggatcacgtttcgttggatatccagtcaggaatgtatggattattggggaaaaacggtgccggtaaatccacgttgatgaagattttgacaacacttgagcaacctacttccggtaaggtgttggtggatggcacaccacttaaagatgcgcgcagtattcggcgcaaaattgggtatctgccgcaacagttcgggttttatccaaccatgaaagttattgacgcaatgacctatttggcaatcttagctgaggtgccggctcgcgagcagaagcggcgaattgagcggttactggcagctgttcatttgacagctcaggcgcaaacgaaagtcaaggcgttgtctggcggcatgttgcaacggttaggcattgcgcaggcgctcgtgaatgagccacgggttttgattgttgatgaacccaccgcgggactggacccggaagaacggatacgatttcggaatttgttggcagattttgctaatgagcgtttggtactcttgtctacccatattgtttccgatgttgaggcaacgactaatcgtattggcatccttgatcatgggcgactggctttcaatgggaccactgacgagcttattgatgcggctgcggggcatgtttttgtcggtgacttaccggtggcgcagcttaaacagtttaagacgcagtaccagattagtgaacaaacagcgcacgggcagcatattcgggtacgctttttagctcgtactccgttggcaacttggcaatcggttgcgccaacactggaggaggcgtatctgtatttacaaacccagcatcatcaagcgttggtgaagacggtaagcggtgtgtgaggaggggtcattgtgaagctgctttggatggaatttaagcggcagacgcgaagtttaacgtttgttatttacacatttttagtcgtggcatttatcgtgatgaatgtctggccattactttcacgaaacttaaccaccctgccgaaatcaccagcgagctacgaaaacatcacggcgaccgattatcagacgctcaagacaaacagtctggatcagttgcactacgattatcggcacaatttgtatacgacttatccgctggggtttgcaaaacaagtgacgttacgcgcggcagaccaggcaaaagttcgccagttgatgactgaggcggaggatgcagacacgcgcgcacccttggttaaaacgttggcaaaggttgaccggctcttgggtggacagtctgcgtacagttcacaaaatattcagaattttgcttatcgccggatgacgaaagccgaagtcgtcgcggatcagcagctcattcggcaacgtgatcgggtcaccggagcgtttgcgagattgtttgcggatattgccggaatcatgatgggcattttaccgacaattgtggccattgctttttgtactgccgatcgccggcatcatgcgtcggcggtgattcaaaccaaggcgatgaccacgtcgcgtttattattgacgcggtatgttgcgagtttaggaagtttatttgcgccagtgattgcgatcgccattgcgttgacgattcaggtcgccgttttataccaagggatgtcgttggattatcccgcgattgtgaaaatggcttttatctgggtgttaccaacgctcatggtcagcagtgcggttggctatttaagtgcggcgatctttggtaattttattggttttggcattcaaattggctggtggttggtaacgatgatggcgggtgctcgccgggtgagtggtaactacggatggttattgatcccgcggcataattcgctgcacaatggcgcgtattactatgcccatttaaaccagctgttgcaaaatcggctcggatacgctttgttggcgcttggactgatggcgttaactgcttggatcttggctgcacaacggggaggtaaactacatgcgctcaagtttaggccgcttcgtccgattagaaattaaaaccaacgtcttgaaaaccagcctcattgcggtactcggctgggggctcattccgattgtttttacgctgacaccgcagagtctggcacaagcagcgatgccgactgagttgtggatgccgctgctagcgatcttttgttttggcagcttatttttaccggagcaaacaacaggggtagcggcagttatcaatagtaaatcgatccaattgtggacggtttacgcggtgcggtttgcttggtattttggcgtattggcagtgctaaacgttacgctgcttggtctatatcagattcagggaacgacattggctgctggcgttctgttgggcaatgcgctggttaagagtttatttatcgggagcatcacgcttggtagttactgttgctctcagtcacttgcggtggcgtatttaattccgaccgtttactttgcgctttgtattggtagcaatcaattaggggcgttaaacttgttgaccttaatgcgtcagcgaccgttaagcgataattggttacaactaggagttgcggcgcttttcatgatcattagctttcttttggcgcggcggcgattggtaaacagttgaaaatagttgctgcatgcaggcgacttgagcgtgtgactttctgctacaagcggtaggccacttggcgtataataagcgtgattaacgttatcatcacgcgtttgccggtgtaggggattaactgcttcggtgcgcgtttcatcagcacgcgctccggctctcaaccgtgctggttcgcgcttgatcataacgcgctcaccagcgcagaagtctgcgtgtaaggacctcggtcgcaatggccaaagtgcggccatcacgcccaaggccgcttacactccgacttctcccgcgctggttcgcgctcacacacaaggaggaattggtgcatgactgtagcaacgcatttttatcagttgtttcaaccggaacattacgatctttacttggatattaaccgggagacgaagaagatttccgggaagacgacgattaccggtgatgccaagcaaaccgaaattgcggttcatcagaagtatttgacggtcagtgcggttcaggctgacggcaaggatgttccgtttacggtggatgatcctgccgaagcggtgcggattactttgccgcaagctggcaaggtgacgttgacactgacgtataccgcaccgttgacggacaccatgatgggtatttatccttcttattacgaagtggacggggttaagaagcagattatcgggacccagtttgaaacaacggctgcacgtcaggcgtttcctagtgtagacgagcctgaagccaaggcgacgtttgatttagcaattaaatttgatgaacatcccggcgaaacgattatcagtaacatgccggaagttcgtgaagaaaatggcgttcattattttgacaccacggttcggatgtcgacttacctgattgcctttgcatttggtgaattgcaaaataagcagacaaccaccaaaagcggcgttaaaatcggggtctttgctaccaaagcacatcgacctaatgagcttgacttcgcgttagacattgccaagcgctcgattgaattttacgaagacttttaccagacgccttatccgctcccgcattcctggcagttggcgttgcctgacttttcggctggggcgatggaaaactgggggcttgtcacttatcgggaagcgttgctgacactggatccggacaacacctcgctggaaaccaagcagcgggttgctaccgttattgcgcatgaactggcgcatcaatggtttggcgatttggtgacgatgaagtggtgggacgatctgtggttgaatgaaagttttgccaacatgatggaatatgttgcggttgatgccttgcaaccggactggcatatttgggagacattccagacgctggaagtaccaatggcgttgcaacgtgatgcaacggatggggttcagtcagttcatgttcaagtagaagatccggctgaaatcgattcgctttttgacagcgcgattgtgtatgcaaaaggtgcacggatgctggtcatggtacgttccttaatcggtgatgatgcgctgcgggccggcttgaaggcgtacttcgaagctcatcattttggcaatgctgccggtgctgatttgtgggcagctttgggtaaagcggctaagttagatgtcggcaccatcatgcagtcatggctggaacaaccaggctatccagtggtgacagcagcggtgattgatggcaaactgaccctgtcccagcaacaattcttcattggtgcaggcaaagatgcaggtcggcaatggcagattccgctcaatagcaattatgctgccgcaccgcagatttttgcggataagcaggtaactttgggcgattacacccagttgcgcgaagcaagcggtcaaccattccgcgtaaatgtgggcaataactcgcatttcatcgtgaaatacgacgccaccttactcgccgatattttggcacatcttgaccaactcaatgcgattgatcaacggcaggtgcttcaagatttacggttactggcggagggccggcaaaatgcttatgccgacattgtgccgttgctgccgcggtttgcccagagtcacagtgccatcgtcatcaacgccttgtatcgggtggccaatgacttgaaacaattcgtcaacccggattcagccgaagaaacgcagctgaaaaccttcttcaatcaaatcagcgccgaccagttcaagcgcctaggatggacaccaaaagccggcgaatccaatgatgatcaattaacccgtccttatgtcctaagcatggcgttgtatgctaagaataaagacgccattgcgcaaggtcacgatctatttacggcaaataaggatcacctgcttcaattaccggccgatgtgcggatgtttgtccttcaaaatgaagtgaaaaacttcggcagtgccaccttgttcgatcagttgttaacggcgtataagcagacaaccgactcaagctacaaagccgatattcttgcagcgttaaccagcaccccggatgccgcgttaatcgctaaaattgtggatcaatttgaaaatgccgacaccattaagccgcaagatttgcgctcatggttccgcggcgtcttgagtaatcacgccggcgaacaagcagcatgggattgggttcgcaacgaatgggcttggcttgaaaaaacagttggcggcgacatggaattcaccacctacatcaccgttatcgccggcattttccgcaccacgcaacgacttgatgaattcaagaaattcttcgagccaaaactaccgacacctggcctaacccgggaaatcaccatggacaccagcgttattgccagtcgcgtcgatctgattcaagcagagcaacaagctgtgcatgaagcagttgccaaagctgttaagtaaaatattagccgtcttggctgatagctaaagagaaatgacaaaaggccgccactcagcgttacagtggcggtctttttataccttcatacttccagttaatgagtatccatacggcatgaaataacgaaaccgcaaccgggcttttagaaaaatctaatccttatctatacaatttcacgggaaagcgaggtggtcaaaccgttacactgaaaagcgagtaactgttcctaatcgagcaggataccgtttggagggatgtttgtggcagacacaaagaaacaactgcgctggtataacgtggccttaatcgcgttcgtatcggtttggggtcttggcaatgtgttcaataactatgcacaacaaggcctttccgttgtcactagctggattctgattatgctgatttattttgtgccctatgctttgattgtggggcagctgggatcaacgtttaaagatcaagccggtggcgttagttcctggatcaaggaaaccggcagtgtgcgattggcgtactatgcggcgtggacttattgggtcgtgcacatcccttatttagcccagaagccgcaagcgattttgattgccttgagctggctgtttaaaggcaacggtgattttatcaacaccgtctcgtccatgaccgtttccttaatctgtctggcgttattcttacttttcctttggctgtcttcgcgcgggcttaccaccttgaatcgcattggcagcatggcgggcacggcgatgtttctgatgtcgattcttttcattattctagccgtgaccgcaccgttgatggtaaaaggcgtccatgtggcgactccgaacatgggcgacattcatacttatttgcctaaatttgacctcaactacttcacgacgatctccatgctagtctttgcagttggtggggcggaaaaaatttcgccatacgtcaacaataccaagcacgcctccaaggaatttccgttgggcatgctggtgctggcgggcatggttgccttttgcgcgttgctagggtcttttggcatggggatgttgtttaacagccaccacattccgacagatctcatggcgaatggcccatacacagcgtttgcaatgttaggtaagtattatcacgtcggcggtttgtttgtcattttgtattcaatcgccaatgctttggcctcaatctccgcgttggcattttccattgatgcgccgctgaaaatcttgctgagtgacgccgatccgcattttattcctaaaaaattgcggcggatcaatcgcaaaggcacgccgattaatggttactggatgaccggtattctggtaagtctgctgatcattattccggcgtttggaattggcaatatgaacgagctttacaagtggctgcttaacttgaactctgtggtcatgccgttgcgctatctgtgggttttcctcgcgtattatttgctaaacaaacatctcgaaaagttccaggccgactatatgctggttaaaaataaacgcatgggcatgctcgtgggcggctggtgcttcttcttcactgcctttgcctgcttattggggatgttaccgaagatcagttatcttaatgatcccggcacatggtggttccagatgggcttgaatattattacgccggttattttgttggcattagggctgattttacctgttattgctcggcttcatgaaaatgatctggatgctcagtgagataaaaaagattcaacaactgcctttagggaagtcgttgaatctttttttgtaagcgcgagccggcgcggttagaagtcggagtgtaagtggccttaagcgtgatggcccggtcttggccattgcgcttaaggtccttacacgcagacttctgcgccggggagcgcgttattgcgcgcgagccgatgcgggaaaaacgtattggcatgtgagcgggcaaaacattagcccatatcattgctggcggcctaagcctgatgtttttcaatcgcagctaacatctgcttttccggataaaagtgaatcagaagcagtaacaggccgtacaacagcaacggcaaccaaacgtaattcaggttaatcatgccaagcgttgcagcattttggctggtgttgggtacgtatccggcaaggtcgaacaatccagcggtgatcaggccgccgatgccgagtcctaagttaacgccgaaatcgttgctggaggcaaacaaaccttcagcttgagcgccgagagtaatgccatagcgaatcgtatcggcgagcataatcgacaccaagccgacaatcattccttgaccgatgctgttaatcagaatgccaggaaacaaaatccacaagttccgcgcataaacaccgcctgcaatgacgaactggccgattaaaccaatgatcatgccaaggcgcatcgtgtgtttattcccatgccgacctgcaatcgtccggattaataaaacaccgatcagcgatgaaaacgtaaagctattggcccaggataccaagccttgattgtgtaaagtgtacttgaaatagtaaaccgtggtctgatttttaatcgccgtcaacagccagtacgtaaagataatgagcgacagcaacaaccacggccgatttttgacggcaattttagccacgacttttagcggttggtgggcgattttttcctgcgtgaaccgttcgcggatatgaatgaacgtattcagaatcagcaccagcgagatgccggcaaatagggtcatggttaagagaaacccgcgctgatcattgccgcggccgaagaaagcaaccaatggcaacgtgaaaaccgcgacaatgatttgcactgagctaccaaagaattgacggatgacgcccagtagcgttaattcctgtggttgttgggttaacgttggcagtaccgaggtaatgggcagattcaccgccgtatataagaaaccgaggacgaggtaagtgacataagcccagatgagtttgccatttgccgaccatgccggcgtgacgaatgttaagacggcaaaaatggcatacggcaaagcataccaaaggaaaaatggccggcttttcccaaagcgcgaatgagtacgatcaatcattaaaccgacaatcggactctcaaaaacatcggcaatacgcgcaactaaaaagagtaaggcaacggcgccggcttgtaagccataaatatcggtataaaaaaacaacagataggtggtcatcacctgaaacaccagattatctgctgcatcgcttaaaccatagctaatacgttccggccatttggtttgccaagaagtagacggttttgacacagataccgctcctttcttagatgcgattgaatggcgaatcagcatgcgggaaaggttcagagtatgattgctggagcgaaaatataaagtgcgccatatacttttaccctgactggctcgcactcacgatcgtcattgtttcaatgcctgcaaaagagactaatcgtgtttttcccgtagcatgtcactgatgacgatttggttgacggtattccagaccatgtgtcccactgcttcggacagatgctcttccactggctgatcttttgcgtctgggacgatatttagtgcaggcatggcccataaatgcgcgccggcccaaacaccaagtccccacatgctgccataacccagtttgaacagcggaacataatgcccggcaactgcgtaaagtgcgcctaagcttgatgaaaagccaaaatgaaccagtagactaacccaaggaacttgatggcctgaataggtgtaggttgcatgcgtctctgctggcgttaggccatgttgttgtagaaaagtttgcggtggattagtcgcatcgcgttccggtgtgcgcggcggcaggatattttcccaccctaatttgactaaaccagaaaccaaccctgcgacagcgccaactgcggctaatttaacgatggaaggtgatgtgtgcgtacgcatgataacgagacctccttcaaaatttgaaactacttccattttagaacaagccgtaccaatccgggagggcagggacccaaaaatataagaaaatttttgtgagtgcatgcatactattatggcttcataaacttatattggcgtggtgttgatggacaaactcaatgaaatcagtggctgccggagcctgataatggtcatttaaggttgccatgtagaagattcgttgccatgttggaaagcttaatggaatcactttaagcggcaaggtttgcagtaatggcatgttaggaaccacagcaatgccaaaaccattcgcgaccaatcctgcgaccgcttcatcttcctcaatcgaataaacactatggggttgggcaccgcactcggcaaataactggcgaatgatcggggccagcccgctttttttagaaaaggtaatctgatcgaatggcagggtttcacttaactcgatttgcttgcgctgagcgagaggatgattcaccggggtaatcacgacaagcgcttgcgaggcgatgggaaaataggcaatatcttcctcttcgtcaacttttgagcaaaagcagatgtcatattttttggcccgtaatccttgaataattttgggtgaaagtccgttttcgttcgtgaactcaaaacgaacatcttgggaccgagtttccaagaaatggcgaaccatacttggtacccaccttgtactaagcgtgcggagtgctgctagcttgatcacggtttgaccgtgtgcttgatgttgcagtcgctcgataccactgtcaagcgtggctagcgtatgactgacagtgcggttaaactctcgaccggctgcagttaggatcatgtgacgaccttgacgcgcaaataaagtgacgccaagctcggcttccaaaccgtgaatagcattgctaagactgggttgcgtgatgtgaagttgctgggcagcatgggtgtaattttgcagtttagccaatgtggcgaagtagcgtaagtgaaaaaggttcatgatttgcctcctgatagattaaacctgaacaatagcctaagactataattaccctcattataatgaattagaagtgacttgtgtaaccgtatacaatcttatttgtaaagagattgaaaaaacaatcacaagcccagcctgacatgcggatacacatggtgcactggctcgcgctcaccataacgtgctcgccagcccagaaacctgcacataaggaccttggtcgcaatgaccaaagcccggtcatcacgcccaaggccgcttatgctccggtttctaaccggtctggctcgcgctcacacaaaatgaggaggaattggttatgtcacagttacatcctattaccgttagttcatggactttaggcgatcaatgcacttttgaagatcgcgtcaaagctgctgcagcggctggttacgatggtatcggtttacgggctgagacttacgttgatgctttgaatgaaggactcaccgatcaagatattttggcgattttggaccgttatcacgttcgctgcactgaagttgagtacatcgtccagtggtgtgaagaaccgcgcagttatgagcaaaaatataaagagcaaacatgcttccacatgtgtcacttgtttggcgttgaacatattaataccggtttaatggaaagttactcagttgagtttacagcggagaaattaaaagcattggcgcatcgggcttcgctggctggtcaactcatcatagcccttgagccgatgccatatagcggcatgccagatttaaagaagacttgggcgattttgcaagcagctggggctcctaacgtcatgatgttgctagatatgtggcattgggttcgtgccgaccaaccctttgacctgctgactaaggaacaggccaagcgagtcatttccattcagcttgatgatgcgtataagcggccgtatgcgaagtcaattttacgggatgaatccatgcacgatcggctcgccccaggcaccgggtttgaagatcgtacggaacgctttatcaaaatgattaaagctgctggcgttgatccgaaagtcatcggagtagaagttatttccgatcaatacatggcaaaaggaattgattgggttgctaagtacacttatgaccacactgttaaaacgttacagacagcttggccggaaattttacaagatccagtagcagcacattaaacagtagcacgctttgaaaaaatgaaacgcgtattttggtatcaatatcaggcacgcaaggaggtaaatgatgacagactggttaggtttaaaagataaagtcgtggttgtgacgggcgctgttggcggcatgggaacgcatttttgccaggcgtttgcagaacatggcgctaaactcgcattagttgacatcaagcatgatgcagttgcagcagcagctaataagttaagcgatcaatatggcgtgcaaacattggcgttggctaccgataccactgatgaagatgaagtggatgcggcggttaaagcggtcgttgatacgttcggtcatgtagatgttttggtgaatacggcggcgattttacggttttcgccatttgaagatttgcgtttagatgagtggaagacagcgttgaatgttaatttgacgggttactttttgatgtcccagcgctttggtcggcaaatgattgtccaacgccacgggacaatggttcacatttcaacggtggcagcagttttcccggaaacttatagcggggcatacagtaccactaaagccgcggttaatatgctttccaaacaaatggctgcagaatggggacaatttggcattcgcagtaactgtgtcatgccatgtctcgtgaagacgccgatgtcagctgatttctataaagatccaaaagttcgcgaagggcgggaacgtttagtagctagtcggcgaattggcgatttggatgacattacgaatgcggtgttgtatttgagtagtgaacgctcggcatatactaacggcggcgaattacgggttgatggcggtctcggtatcatgatgcaagacatgattcctaaaccaggtggccggcgtgaatatgcgattaaggcacatcagcctcaaaaataggcagtaaaaataagataaaacttggtgcaagttggccaagttcttcttttgcggtggatagtgaatatatgaacatgccttgaacgatgatttgatgatagcgcgctgcgacttctaaccgcgccggctcgcgctcaatataacgcgctccccggcgcaggagtctgcgtgtaaggacctcagccgcaatggccaaagcccggccatcacgcctgaggccgcttacactccgacccctaaccgcgccggctcgcgctcactttctttgaggaggttttttaaatggaaacttggatttcaggaacgacgcaattgctatgtctgcttggcagtccggtggggcattccggttcgccggcgatgtataactttagttttcaaaagcaaaagattgatgcagcatatgttgcatttgatgttaaggaggatcaaatgccggatgcgctgaaagcaatgcgattgttcagaatgcgtggcggcaatgtcacgatgccatgtaagaatgtcgcggctactttgatggatgagttgtcaccagcagctaagattattggggcggttaacgtcattgtgaatgaaaatggccgtctgattgggcatatcacggatggcattggatttgtccggaatttgaaagaacacggcgttaacgtcaagggcaaaaagctagtggtattgggagctggcggtgcagcaacagcaattgaagtacagacagcacttgatggcgctaagcaagttgccatttttaatcgacaagatgctttctatacgcgtgcagagacgactgccaaaaagttggctcaagcagcaccagacgtcacggtcacggtagatcacttggaagacgatgctaagctcaaggccgctattgcccaagccgatatattggtcaatgccaccacagttggaatgaagcccaacgcaggaacttcattggtcgatccagcatatttgcggtcggatttggtggtagcggataccgtttatagtccgttgaaaaccaagctaattgaagatgctgagaagtgcggcgctaaaacggcaccaggtaaaggcatgttgctatggcaaggggcggcgggttacaagttatggacaggacaagatatgccagttgtggaatatcaggcttttgaagcgagtcattaaatgaaatgttttgcgtaaactgacggtagtcgcggaacttgctgtcatagcgcgttcaccggcgcagaaatctgtgtgtaaggacctcggtcataatggccgaaacctgggccatcgcgctcaaggccgcttacactccgacttctaagtgcgccggttcacgctcactaggaggtgtatggatcgatgaggaccaaacataatgtgtatttaccaggagcactggctttgtatttttcatatgccatgctaggagttgcgtcttccattttgagtcaatataaaggccagtttgcttctaactggggtgcacaggagttggcgaatgggactgttgatgtcagtatggttgtttcggtgattgcggcgtttggattgggtcggttgttagcttatccctttgccggcccggtttcggatcattttggacgtaaagtttctggcaccatagggattggcttgtatatcattttctttgttgggattatcacggtacatagtttttgggcagcctatgcgatcggcgtgctcaatgggatggctaactcgtttttggatacatgtgtgtcaccaagtttgatggagatgttccctgaatcagcttcaattgcaaacttattgactaagtttgcagtggtgatcgcccagtttatcctgccgttctttatcggaggcgtggccgctgcagggtggtcatttcagacaatctttatcatttgcggcattgcgttggtcatagatgcgctcgctattttgctgagtccgtttcctaaccgtgacctacctaagacgaatgctgccggacaatcggaaaagatgcacttttcgctgggagcggttgcagcaattttaattgggtttacaagttcgacgacatttatggtttggctgaattgtaatcaggaactaggggctgcttacggtgtgaagaatccggcatcattacaatcgctgtatgcagtcggcgccgggattgcggtgttgctaacagcacgtttaatcaaattgggtctcaaggagagtacagttttagtcgtttatccggtcatttcagtcatcatgttgctactgtgttactttattcaaacgccgagtattttgtatattggcagttttgttattggttatgcggctgcaggtggtgttttgcagttggcaacttcgacaacgattaacttttttccgaatcacaaaggcactgccacgtcactggtgatgattgcttcgagcattgccaattatgcggtcctttccggggcggccggtttaaccaaactctttggcgatgatgccccacgcatgattattttgctgaatgttgccatcaccatctgcggtattggtttggcgttgatagttaaagcacaggaaaaacggataccggccttgtcacaggcacgctaggaaggaagaacaaaaatggcgcaaaaagatgaaattgacggacacacggtgctagctggattgttagcccatccagctggtcattcattatcaccggcaatgtacaatgcgatgtttgaagccttgggattgaatgatgtttacttgtcatttgatgtggatgtcccggaactggggcatgctttgcaatcaatgcgtagtttgcactttttaggcggaaatttgtcgatgccccacaaacagcgggcgctaccattattagataagctctctcctgctgccaagctagtcggtgcggttaacacgattgtcaatgatcatggggtgttgattggtcatataacggatggcacgggattcatgcaggcgctgacaaatgatggaatcgatcttcggggtgacaagctgacactggctggagcaggtggggcgggaactgccattgcgattcaggcggcattagatggtgtccgtgaaatcgctatcttcaatcgccgagatgcttcgtggcaaaatgcccaacgcaacgtggcggtgatcaatgaccagacgtccgcccatgctcaactgtttgctctggataatcatgctgcattaaaagctgccattgctgacgcggcgatttatgttgatgcaacggcagcagggatgaagccactggaagacgtcagtaacatacctgatcccacatggctaaaccctgaaaagattgtctttgatacggtttacgtaccacgcgaaactaaattattacgcattgccaaaaaagcaggcgttaaacatgtttacaacggcatcagtatgttgattaatcaaggtgctgccgcgtttaatttgtggaccggcctgcagatgccagttgaaaccattcgtgaaactattttcggcgagtcagaggcacccttgaaaaatacggctactgcttaaaaagtgaccggtttgcacctgaatacaaagatgagaactgttgatcatttaaaggtcggcagcttttttatatccacctatcactcaccctaaaaggactaatctttccaaaagtttttacgaatgaattaagatgaaaggttgctatcgatcttacatttagttagtatatagttactgaaagggagggtattaaaatatggcaaaccttattggtaacaagcgatgttggcgctatcagctttatcaggatatcctcctgatgtgttcgtgcaggtgagacatcggcaagtaccttgcttaacggtgtctgcaggcaatcgtttcaaaattttgccggttcatgcgagtcaattggccgggttgggaggtgaaccttgacagaagcaccacttaaaatcgggattctcaacgtgatgcacgacaaagccgataccaaaacgcggctgcaacacgttttgagccacaccgatatcccggttgagttgcatttttactatcccatgacccattacgctggtcgggaagtaccggaagcggtgagctcgattctggagccgctggatattcacgaagcggcaacgatggacgggtttatcatcaccggctccccgattgaaacgctggaatttgatcaggttcactatatcgccgaggtgcggacgctgctaaagacattaggtcagcatgtgcccaaccaaatgtacctgtgctggggcgggatggtggcactgaattactttttcggcgtcagcaagttgattcttccgcacaagttattcggcgtttatccgcaaacaatgcttgaaccgcacccatttttaaagggtttgaaagaaggctttaagtccccacatgctcggtatgccgagatggatgtacgcgatattcgcaacgatccccgcttaacgatcaatgcgacaacaacgaaggggaaactcttcatggtgacggaaccgactgacacccaaacgtttatcttttcgcatattgaatatgaccggtggggcttggattcggaatacaagcgggaagtggccgcacaccctgagattagctataaacgggctaaacactattatcatcacaagaacgattatgaccatccgaagtttaattggaagaaaacgcagcgaacgatttttgacaattggattcgccacatcgcggatcatcgcaatgaaaaccgttcgccgattatttagggaggctttattatggtgacagcagcagataatattacaggtttaattggcaatacgccgctactcaagctcaatcgcgttgtacctgaaggcgccgcggatgtttatgttaagctggaattctttaatcccggtggttcagtcaaggaccggattgccttagcgatgattgaagacgctgaatataaaggcgtcttgaagccaggcggcaccattgttgagccaacgtccggcaacaccggtattggtctggcattggttgcggcggcaaaaggttaccacctcatcattaccatgccggaaacaatgagtgttgagcggcgagcattgatgcgtggctacggagccgaactcattttgacgccgggtgccgatggaatgccgggagcaattaaaaaagcagaagcattaagcaaggaaaatggttacttcttgccaatgcaatttcaaaaccccgccaatccagacgtccacgaacgcacgaccggacaagagatcattcgttcatttgatggtggcacgccggatgcttttgtagccggcgtcggcacaggcggaacacttaccggggttggtcgagctttgcgtaagatcaatccagatgtacaaatctatgcgctggaagcagcggagtcaccaatgctaaaagaaggccatggcggcaagcacaagattcaagggatctcagccggctttattccagatgtcttagatacgaacctctatcaagacatcattgaagtcaccagcgatcaagctatcgacatggctcgccacgtcagtcatgaagaaggcttcctaccaggcatttctgctggcgccaacattttcggtgcgattgaaatcgccaagaaactcggcaaaggcaagagtgtcgccaccgtagcaccggataatggtgagcggtatttgtcgacagatttgtttaagtttgatgattagtaaaactattagttataggtaagcaaaatagaagcggcgatcaattgggtcagttgatcgtcgctttttgtcttgagaaaatgagcggcagggaagattgcgtgcgtcaacattgaacaagattgttataatggaatctgtaagtctccatggtgcaatggatagcataatggtcctcgaaaccacagatccgagttcgaatctcggtggaggcattatttagcgtttattagcgtactttagaaatgaaaatgcctttatatcagtgttctcattgatttagctcaccttagaaagtgtcaggattacgttaagggggacaaaaaggggacacaacttgcaaacacgagatggagaaaccggactttgttaattctcggtttcggtaagattcgttatcttagcccatgtcaatattaacgcgcaaaggagttgtggtcagcatgcaaccagtcttactcgcaacggttcaccaccccaatgtgtctttgccgcagttaaaacaggttctggcagtagttagtgatagtttctcggctgcctatctgacggttagtacgattacagaccttaaagttaccaagttactgcagacttttcccagcgtccatgttcgcgtcattgaacctcgtggcgcggctgatgcgcggcggagggtacttgattttggattgcgtcaggttcgttaccacgcttcttttttttactgcgattttgataaagtggtgacagggatcgaggcaaatgtatctgagtttaagacctttattgcccagcttcgagttgatgatggctatcagattattgggcgaagttcagaaaacatgcggggttatccggcaacttggcgagaaaccgaggcaattacgaataaggcggcttctgaagtgtttgccttgcctgatctggatattactgctggctgttgtgcggtgagtcggatggctgccagatatatcttggctaattcgaatggtttgctgacggatacggaatggccgttaatctgtaaggcggcgggattaacgatcacagccaaacgcgttaactttttaccgtatgtgccggctttaaacgcaggtcgggatgacgataactggcacggttacacgagcaggttgcgacttgcattgcaggcgttgcaatcgcttgaaacagatgggacggctgatcttaaccaaccagtttcaattggatggccatataatgaagattagtatcgattgataagatatctaaacgaacgctaaaatgtgccctgtttatcactgttagcgtagcagtgatagacagagcacatttttacgtccgctgatgtatttggccagatccgactgcaagtgaactaactagatgtttctgttgagtatggttgaatgtgggcactcttcaaactttgaatggcttatgccaaattcgtttcaaaatatgtcaaagttgagaatgtcgttgttagttgattatgctatattctgcggaatggtaattaagaaagggcaacgcattatttcgtctttttgttggttgtaaagtatttagctatttttactgccagccaagcaatcagaaaaacagcgatgagacgaatgtaggttgctgatggtcccacccacgtgcttatcatataagcaatcggactgagaatgataatcgtacagaaaacgatcaaccagtatttcaaacttaatgactgagcctgtttcactttttcacctcgcgtctatttagcaaaagtaatagatattctttttgtattctttttgctgctatttttccgctgctgccagtgcctgctttagatcgtcaatcaagtcctgctgatcctccaagccaattgcaatccggacatgttgcggtgtcaaaccagaatcggcgcgtttgtcttccgggagcttaaaccaaggtagtttgaccagactggagatggtaccaagtgagtcggcaaagtcgaaaattttggtgctgttaacgaactttaagggatcaatgttgtcggctagtttgatcgttaagagtccgctggcacccgtggtttctttttgggctaatgcgtaaccgggatcggttttaagtccggggtagtaaacgtgggcaacgtctgggtgctgcgctagaaattcggcgacggcttgggcgtttgcagtttcacgatcaaggcgaacggagagggtggcaatgccgcgggtgacgaggctacagtcaagcgggcttaaaatggcaccgatcgtgttttgcaggaaagcgagcttctcgctgaggtcggggtgagcggagacaacgaggccggcaatgaggtcaccgtggccgccgaggtatttggtggcgctgtgtagaacaatgtcggcaccgaggtcaagtggccgctggtaataaggggttaagaacgtgttgtcgacaatcgttagcagatcatgggttttggcgagggcactgatggccttgacgctgctgactttgaggagcggattggaaaaagtctcaaagaaaattgctttagtttcggggcggatggcggcttccaccgctgccagatcacgcgtatccaccggtgtaaaggtcaggccgtgttgagaaaaatactggttaatgaggcgatcggtgccactgtagagcgaatcaccaataatgaagtgactgtggtcgggaaaaatcgcgagcaccgttgcaatcgctgcaacgccgctggaaaacgcaaagccggcatcaccattttctagcgtagcaatctgacgttccaagtattcgcgggtcgggttaccactgcgcgcatagtcccagtgggtttcctgaccatcaggagcaaagcggaacatggcactttggtatacaggtggcacgatagcaccggcttggtcgacatttagttgtggtccatgaacgagtttggtattgaattgggtcattgaaacccgacctcctttaatgaatagtgttcttttatgtatgcccgtcaatgaaacaggttgacgggcaatgtttgatggctgaatggcatgattacttggtggttaaatcggtgccaaaatatttttgcgacagttttttcaacgtgccgtctttgcgtagttcttgaatgccctttgaaagtgcggcttgtagtttaggcgattttttgctgaccatgccagctacttcatcgggtttaacgacactatctttgagggtttgactctttaagcccgcggttgagttatttttggcaaaggcataccatgcagccgaggcgttgatggttccgtctgcccgcttttctttcacaaggctaagcgatacggtaaagtcgccagacggggtgatcttagcgccgtattttttggctaaagcggcattgggtgtaccggtgccttcaacaaatgttttgcctttaatatcggcaagcgatttgatggtggtgttatcgctgcgggttattaaggcataacgcgagtacatgtacggagtggtgaagttgtagacctttttgcgtgcgggcgtttcactaatatcattcagtacgagatcaaatttctggctgcctaatcctgcaatcagcgaatcccattgggtgggcacgaattttgccttaaccccgattttcttggctaaggctttccccagttccacttcgaagccttcaagtttgccatctttgcgataagaaaatggcgcataagtaccttcaaggccgatggtaagctcatttttgttgatgagttcggcggtgacgtcactgttttttgacgtgtcagatgacgtgccggtgcaagcggtgagcgtgaaggttaccaaggccacaagcggcaacaggaaccacaactttttctttaacatagctttcttcctttcaaaatggcggattataattgcgtggtttgtgcattggcattgtagcgtgatgtgaatttttcgagataccgctgaccccaagctaagaaagtgcagacaatggcatacagaagcgcaacgattgagtacatcagtaatggttggtaattttccgccgcgatttgttggctgacttgaaacatttcgacaatggtgatcgaggcagcaagggatgtgtctttgatcaggctgatgaaactatttgacagtggcgggatggccgttcgtagtgcttgaggaataatgatttcgcgcagcaccagtcgccgcggcaatccaattgcataagccgcttcccattgcccggaatcaatcgacaacagcgaggcgcggatcgtttcggcacaatacgcccccgtgttaagcgagaatgttataattcccgcggccactggatctagcttgataccatgcgggaaaatacccgggatgatgaggctgggtaagccgaagaaaacgatgaataactgtaccagcaaaggcgttgagcgaaagagccaaacgtaaaaaacggcgattccttttgcgattcggatcaaaacacctttacgaaccgatatgcgcgtcaatgcggttacaagtgcgatgatcaggccgatcgcaaatgacacgagtgcaattggaatggtgtatttaatgccggctgctatcatttgcggaactgcatcggtaataattttccacataatgttcctcccaaaataacaatatatgcagatgttgatactcaagcgaattctttagtcgggcaacccgatatagcattttgacttcaaacttcattgaggccgaggagggaacaaaaaatccgcccttgcctatttaatagacaaggacggattctttccgcgttaccaccttgattagtcgaaatgctcgactcgctctaagtacgacacatcttgatgtgtgatactctaactcagtaacgggagtgcccgtcagttgcttgcggtcgccgtttgcaactgaatgctttaaaagaccatcttcaccagttcccgatcattgtctttcaccaaaatgacaactcgctgaggatcttcgcctgggtactcatcttttcgcttctaagatattgacatcacattaggctaaaaaacaactgttgtcaatagccggtgacaaatcgtaagctgtacaaggttgatatacgatgagaactgctttgacgagggcttaggcaaaaatgcgcttttctcattaaacgatgtacatcggtgacggctacccactagtcagttgacggatgatcatccaaaaaggcgaacttggcagatggttgatccaaactaaagcataaagccgtggcacatttttaggcctaaagtccagtgactttgtttgtaagatgcggtatattaatgtcggagtagttaaaagggatattaatattttagtgtttaagcggagggttaagatgaaaaaggcatgggcgttcggcttagctgccatgcttggcttgggtgtatcaacggtaatggctgatcaggcatcggcttttgctgcatcagcgccgccaacagcagcggacacaaccacacaaaagattgatactgaccaaaagaatacggacgatcaaacttgtgtacaagatgatatatcatcggaagctaatcaaacgccggtgattaccgtagcagagaccagcgaatcggttatcaatgacagctcggcatcaaattccggcagtcaacaagatgagcaggcatcggagagcagtcaagtgtctgagaattcctcagccacgagtagcagggatgcgaacgcaacaacagaagctgggtctaaaaagacagatgccaagagtgaagcatctagcagttcagtacctacaattaaaactgagcaggagagcaataaaggttccaaccaaccgaagacgaaacatactgctgaagaacaagctatggtggtagcagcgcaggcagcgacgcacgacaacattcatgtgaagatggatcagggggttcaggctgttacccagggaactgatgacttcacgatttctgataagccgcataatacattggagcgactgtggcaggcgttaatcgaatccgttgcacaccggcaacaatgcccaatcagctttgaaaatcggttgatcatgaccacgccgacgactaatcttgcctttataaaagattcattgacgccggttaagaagcacattaaggcaaccttttctgatgatatgctgaaacggatgcttcaaaatgattttttgaaaccgcttcagctaacgtttaaggacgttaccaagacgcttaaccaaataatgttagttcttgtcatcatgccagatagttcaacttcgcaagaataaagaagctttgaaggattatgatagcaggtaaaaggcaggtaccgaagacttagaagtgcagtcttcggtacctgcctttttatggatttagcgtttgtagacaatatccggtcatcagcttggaattaagctggcttttgggttgatcggatatcgtgtactagcttagttttgttcagcttcgagatgagttgctgcgactgctctgcgaactttgacggcatgtgcgacgaggccaaggacgagacccacaccagccggcacgagccagccgagacccattgcggaaaatggtagaaaatgaagctggaagctatgcagtgccaagcctaacgaactttgactgacaatggcgggaaaagctgcaaacatgtcgagcacagccggaacgacggtgaatgctacaacgattcggtaaaccagcggatcgtgatggaacgctttgccaaagaccgatagtaagatgagaaccattgagaaaggatataggaacatcagcattggaacggaccatgcaatgatttgttcaagtccgaagttggcggttaagaatgacagaaaacttgtcaatccaagccagacctgatagctgactttagggaaatgccggtggaagtcctgcgcgaatgccgcgaccaaacctaccgcggtggtcaaacaggtcagcgttagcaaggttgccaagacagcgtggccagcagtaccaaagtagaacgtaaccacctgattaaaagcagttcccccttcagcactaagcttaaagtgggccagagacatacttcctaagacgatcaaggcaacgtagattaacgcgatccaactcgtagccatgaccccagccttagccgttgctttggcgacatgatcatcgtttttcaagcctaaaccgcgaaccgccgttacgacagtcacaccaaaggctaaggcagcaagcgcgtccatggtattgtaaccctgcaggaagccgctcatgaaactgccgccatttttgtatgcggccgttaccgtttgggcagccggattccccattggatgtaagaaaccgatgaagaagacgaagaataacaatagtaagaagacgggatttaagactttaccaacagctgtggtgattttgcgttccttgtatgacaggaaaaaagcagccccaaagaataaagccgaaaagacaagcaagccgccttgttgccaggcttttggtaacatcggtaagacgccggtggtgaaggaaacagtggcagtccgcggcgtgccgaacattggcccgatcgtggcatgaatgagcaccatgaacgctaaggcgaaaaagcggccaagtggacggccaatatcatagacaccttcagcatgcgttgcggcgatggccaaaacgcctagtaatggtaatgcaacggcggtgaccaaaaatccgagcattgccgggaaccaattggccccagccagttgccctaaatgtaacgggaaaattaaattgccggcgccaaagaaaaggccaaacaaaagcgatgcaatgacgacataatcacgtgttttgagtttcttttcagataattccattgaactgcctccaataaaaatgttttaagttgcgtaacgtttaaagcgtttgtcatcggtttaatgtgactaatgtcagattccaattgcatcacttccttaattgagatacgtgaacggttcaagcttgttcccacaacggagatagacgaaaaaagccgcccttagcatttgctaagggcgactttgcgcggtaccaccttaattcaccatagccaaaaatggcctagtcttcatcgcatacggtcaaatgacgatatgctagcactgtaatgggtgcccccatgacacgttactgaaggttcggtgtcctgcttgaaagggatattcgctatgccctgaatgcttcctcacaccaaccgaagctcgctgaatccatgaacacaactacttgtctttcgcgttgcatttgtatttgattttcagtctagcatgatttggtttcatgtcaatcactaattgaaaattaattttgaaagcaaaattgaaaaaagggcaaaagttgtgaaatatcaaagattttgaagccttgggtgggtagaaatttttgggtgatcggaaaggcgcaggcaaaaagatttacagagtcctaactgctactcgggttaatttctgccgaaagtccaaatgagtcgttttaaaacagatgagtaaaaccgacttttcgattaaacgataacaagcgttagataatgcttaaaatagtatatttcgtttatttagtcgccgtgaagctttcttagggacgattatttgtaaaaaatgagtgatgggttaagaaatacaacgtgattgggaactgagttaacaagtaaacgtattctttgattgctcaaacaccatcatgttatatttaggtcagtaagatagatagtaaactataggcaaagcaatacggagggaataaagtaatgaagaaagttaattgtattgcagcgggtatttccgctttgacgcttgctggcatgatgctccctgttggacaggtttttgctgctgatcaaagcaagaagtcagtcgcagaaataaatgttgaagctggcgttttgacgcttgaaaaggttccggacttaaggtttgataaagtcagtatcgcagagttagcaggcgacacgggcgttaccaagaatctgattgataattcagtgtcagaccaaggccctgttaaaacgagtggcgctaatgctgctaatgctgatggcaataacaccggtgagctcactatcactgattatcgtggaagtggtctgggctgggagctgacagcacaggttggcgaaatgattaacggcgctggacagagcttagcaggaagcattgtgcttaaaggttcgacaccagttgtagatggaagtacgcctcagagtgtaagccctgatacagaagtaattttacctatcaatggtgcggcagtcacaatttggaaagctgcagctaaacagggacaagggaagaacacttcaacatttaaagctaacggtggtacgaagatagaactagcttccaacaagaccgctgttgctgggcgttaccaagctccaatcacttggaccttgtccgatgcacctaagtaattaagcaactatttctggggcagcggtcaatcgctgcccttttcataaccgtggggataagattatgagaaaaaaacttttactaggtctgctggcctgcttgagcttcctgtggtttggcacccatcagcaagtgcatgcagctgaaggcgcaggttttacaatcagccccgcattaccgcaaaatcagattgatcaatcaacgtacttcaatttactggtaaagccgggtaaaacccagcggctgctcatttatgttaaaaatacgacgaagacagctaagaaacttaaagtcagtccggtgagtgcgtttacgcaaaccaatggcacgattggctactaccccaatgatcacaaggatgatacggctgaatatacgttttcacaattagccggtgagcctaagaccattgatctagctggggatgctcaggtgccggtgacgtttgatgtcaagattccggcaaaaggctttaccggtcagatcctcggcagtttgtatgttgaagatccaacggtccataaaagcggcggcggagggatggcgattaacaacaaatttgccatgctcatcggggtggttttgcaaacttcaacgaccgaagtagcacccgatcttaatctcatggcggttaaaccagggtcacaggataatcgagccggggtgttggctactattcaaaacaccaagccacgtttatttggcgacatgacagtggacggtaaggtttatcgccaaggttcagataagccatatttaagccgaacggaaaagggctggtcatttgccccgaactcacattttgattacgcacttccttcaaaagaggcactttcgccgggcacgtatacgctagatttaacagtcaaagcggtcgataaaacctggcactggcgccgcaactttactattacgcgtcagcaatctgaagccattgagcagaagctgggaagggaagcaccgcaaaagccgtggttgtggattatcattgcggtcgtcctggcgttagtgattctcgtcttgctgtggctggtttggcggcagcgacgcaaagggagggagactgatgaaacaaaagaaaactaacttcttgatgatgctacttttgctggcactgttcatgatggcgggtaccgcaactcagagcgtgcatgccgaagtttctgtggctcaagttgaactcaccggagaaatgccagccctcaatcctgagcaacccgcagttcccgagcccgggaagccacatcaacctgaagataagggacagcagccaagacacttagcggccactgacaaacgtttaccgcaaaccggtgatgccgtgcaggtgtggtatgtcgtgattgggcttgaaattctaatcatcgttttattgtccgcactgctcatacacggccgttcacggcgaggaggtcaaaaatgaagaagaaaatattcatcataacctgccttgccgtgatgatcagcatggtgcttgggccgctgcagaccgtgatggcggaaacaccaaaatggccaagcccgggattaaacaacaaagtgaatgtttatcctataccgggagcggggacgttcactagcataaatggcgtttttgacaaaatcgaaggaagcaattcagctccgatcaatgttaataatgatacagtggcgctggaattgaatgctgataaggacgctcaggttggggcgatgtggagtaaaaaaccaatagtcgatttgactaataactttacgcttgacctgcaagtatattttggcaacaagattttaaatggtgcggatggacttgcatttgcactaacaggtaccagacctacgaacgcaggaattaacggggcttcgcttggggtttggggcggcgcagatgggagcagtgcagcgacgattgctgctcaaggacttcaaaacagttttgtcgttgttgttgacacacacaaaagtgagaatgatcccgatgcgctttatccaaatttgcttgagaatcaccagtatgttggctcaggttatcccggaaaaactgagatgtacggtattcaaaataataaatcaaagctcaaattcggggcggccctgatgccacctagttatgttaatcaaattaaaaacaacatttcgaatgacaaatggcatcgtttgtcaattagttggcaggcttatccagaaggcggaggggctttgacttacagttttagtaatacaagcagcacgccagcccaaacgattacgcaaaccgtcaaatggacggaaaccgaaatggacaatatctttggccagaaagtaagacaagtttaccttggttttacgagtgcatccggccctaaagtccttattgactcatatatggaaccgcatctcattaccatcaaaagcctagctgatttcaatcaaattaaaggcgccgtaacccttcagcgtgggacagagccagtagtagaggacacattgttaaaaatcggcgacaagctcacttatcgttacgtcattgatgttgctaatctggagggttcagaatggccagttaatcaaatcatattacccaaaggcaaatattttgactatctgaagccagatgggaaacctgccgttgcgggtgacaaattgccggtttcgattacggtaaatggccaaaccgttccggcagaagcaacggtgcaaagcgatggcaattcagcagtaatgaccgatctcgggacattgccaaaacgggctgatagcaaacttgaatttagtttgccagcggtggttaaacaacacacattgaccagcaatttgaaggttgataatgatcctacaggtagtgtcacaggtggtgcaaccacagcgaaaacctatacgtttgtcaatacggctgatcaaaaggacggtaagtttattaaatatgtcctcgcaggagaaccgggagctgtcactttgaagagtgttccgagctttgtttttaaaaaatttgtgaagaaaggcagcgaagatccaaccaacgtagatccgacagttgctgattttattcaaggctttccaggacaagagacttttccaacaacgatttcagaacttgatttgtccaagtggttaaacacgcttgattcagaggcaccttctcaaggagcaacaggtaaaattctcagcgtcactgacacaaggctgaataagccgggctggcatttgcaaatgagtttatcaccattcacattagaagatggcagttacgtcttaggcgacaacggcaacgcaaacgggggtaaagcagaaatggttatcgctgagaataaagatggtgaacaaaaggtgactgaaattgcacgggtaaaagacgatggaaacactgtcacggtaaaaaacatgcctcctggcggcagtgattggtcactcggaacagaggcaatgcaaacgcaagccttcatgtcgattcaaaagacgccatccgttcgcaccgggctgtatcgttcaacggtaacctggacattatcggctactcctatgccttaacaactgaaaatgacattgaaatgaacagataatgaggatatgatgtgtgtattctattgttgttgaaaactgtcatttgagttgaaaaggggttcagctatgaagaaaaattcaccgaagctagcacttctagtaatcagcattgtagcagcaacacttgctgtcgtctctcaagcacccattcacgttttaattgcgagtgttagtcacttcggttaaggcaccttatctcctggatcaaacgctgaagccgcggagaaacgcaatgcgctaattttaattaaagaccgtgtgattaagagttcaacctcttagaaactgtttgaggtctttgaaagacgcttgaatttccggtaaaatatgtgaaaaaaggacttcattatgactgattatccaagcaatatcactcgtgaccaatttgaattgattcgcgttgaccttgagacgtttcgcaagcgtacatgtcctcgaagggtggacctatttgatgtcttcaatgcagtgctttacgagcttcgtacgggcgctcaatggcgtcagttgccgcatgattttccgaaatggcaaaccgtttacacttactttgccatgtggtcaaaaccattagctaattcggaatattccctgattgacctgcttttaaaaaaattgtcgctcgagagcgattacgaatgggacgatcggtacgaacgtcgttcgtaattcttgatgcgcaaagcgtcaaaaatacggcaacaccccaaaataaagggtatgatggcggcaagaaaatcagtgggattaaacgccaccttgccgttgatattaatggtctcccattcgcgatccacattaccacagctaatgtctccgaacgggacggtgcgatcgctttactcgcgttaaatgaagagcagtttgatcttgttcagcgagtgatggccgatggtggctatacaggcgacaacttcgcccagtcggtccatgcaatcattggtgcagatgtcattatcgccaaacaaagtgatctgaagaacggtcaagtaacgccacagcgctgggtcgtggaacgtagtttcagttggttaaccaactggcgacggcttttgttcaattgcgaacgcaagttaaataccagtaaagtcatggttgctatggcctttatagggatcctgcttgctcgtcaatagagacctcaaacagcttcttagttgcacggtcctttttgattacgggaaatataagattgattcaatgtcacggcagcggcagtattttgaaaatgtcagtttttcgtgaatggaggaaagtcaaaatacggcacttttagttggtataaatataattgtgcaaaaatgaaagcaagaatataatcgttgaaaattattaaataaatgcttttaatcaaataatatcaattttttggaatctatgttttggtaaatgatattttaaagatttgaaataattaataatattgttattgactttataaggaagaaaaaaccaaattatttaaattttacatcaagaacataaaaccagacgcacataagcaatataatgctgacgattcaagaatataaattctataaataacgtttaattactaaaatataacaataacaattgtaatgtttgaagaaagcgcttgcatttggattaattcgagaatactataatagacgtagagaagaaaaacaaatcaaataagaatatggaggataatttaatgaaaagagttaactacatggcgatgggtcttacagcattatcgctggctggtatgatcttaccagtcaccaatgtattggctgcaggcgaggctgacacgccatcaaagaagacttccgttggtgaagttcgggtcggggtggatccgactaatccagacccgaaaaacccagacaatccagatggttcgaaggatattttatcattggtaaaagttccggatctgaagtttaagagcgtcagtgttgaagccttgtctaccggcgatcaaactttgccgttactaaataatacggtaactgacaaaccagtgaagaatgaacctgctgggaatgcggcagatggtaataatcagggaatcttgaacattacagactatcgcggaactggtgcaggttggcgattggaagctcaggcaggcgaacttaagaatgaaacgggtcaaaccctgggcggcagcattgtattggcgggtgatatcaaagcggacgaaaccgataataatccggcagcgctcgcaacaaatcctgaattagttctggcaggtagctcggttccaatctggcaagcggctaaagatcaaggacaaggcagaaacacctcattgttcacctccccgcagaacctactgaaactgaccaaaaatgttaaggcctatgcaggtaagtatcaaactgcgattacctggaccctgacaaatgcgccgggtaactgattatcaaacgtcagaagagggacagtgatcttcgactggccctcttttgccaagtttaacgctgaatgattggttctttagccaagttttgcttgaaaaaggaggtgctaaccgatgggatttagtacgtggcgtttttggatcaagctggttgttttaatgggcttcattggcttgagtagtgttgccgtctatgaggtacaagcagcaacttccatcggcgaggtgatcgtgatagatgatcgaccacaacccgctaatcccattaatgcgcctggcagcgacattttaacacccaagccactgaaaaataatttaccgcgaccacctaaatcgacgccgcttcgcctaccgcaaactggtgaacacagtcagcagggtatgttaccggtgattggcacgatgctgttactcatcaacagcatgggcctgagcttctggcgcgggcgaaaagacaagggggatgaaaatgaaaaagcaaatccttagtcttaccaccttgttaatagcagctggaatctcaacagcctatccggtagctgcggcagatgacttagggccaaaatcatccgtggctcaattgacagttgatccaggcaatatcgttttacagcaagttcctgacttaaattttggcggcatttccgtttatgaaattgttagcggacagttcacaaaacatgcgttacgcagcaataaggttaatcaggggccggttaaaaatagtacgaatgctaatgacggtaacgcgtctgggttgttgcaggtgggtgattatcgtggcaccagcgcaggatggacgttaacagcaaagatggacgcgctaacggatggtaagggacattttttggaaggttatattgatctggtggggacgaatccgacgacgagtaatcctgatttgaatgccgttcacccagcaggggcccaagcgccgcggttgaagtttgccaaagatcaacaaacgcctgagacggtggtttggcaggcagatgctgcaagcgcgactagtaccgggcaagggcagggtaataatcaggtgactattagcgctggtacggagttgacgttggtttcaagcccgatcaatgtcaccactcaaataggcaggtatcaggcggcaattacttggacgcttgccaatgcgccgcaaccttaaaccacatcaatgcgttcaccagtgcagaagcctgcgtgtaaggaccttggctgcgatggtcaaagtgcgaccatcacgcccaaggccacttacactccggcttctaaccgcgctggttcacgctcaccataacgcgttcatcggtgcagaagtctgcatgtaaggaccttagacgcgatggccaagagcgggccatcacgtctaaggccacttacactccgacttctaaccgcaccggttcacgctcaccataacgcgttcgccagcgcagaagcctgcgtgtaaggaccttggtcgcaatggtcaaagtacgaccatcacgcccaaggccacttacactccggcttctaaccgcgctggctcacgctcactttagaaaggagtgatgatcatgaagaagtgcggctacctggttacttggttgggcttgctggttagttttttgatggtggccccttccgtgtcggcgcacgccgcggctgggtggccgtcatcgtcagggtaccccgcaccgccatcattttctgatgttaccgggctctttgaaccaactcaaaaagattcaagtttgattatcgattctgcgacgggcagtgcggtcggaatggaaattaataaagatgctcctaaccaatccggtgccatctggagtacggcgcctatgtttgacttggacaaagatgcgtcatacaccatgtattattatctgggtaataaaaccacaattggtgaagggatggcgtttgtgctggcagctaaaccagcggcaccaaaacaaattgacccatcatcgcttggtatctggggtgtcgatcatttacctgcaggcagcacctcccagcaaatagctaatacagcattaccaaatagttttgccttatatgttgatactcggcgtaatggtggtgatgctgcaggtggttatgatcaatatagtgcttataccgattactattttggcgcgggctatccaggacaagccaatatgtatcgaatttctaatccttattggatgtcgtggctatattttaaaggcgatcctccttttaatggcgtccaaaccggaattggccgacagaatacccttgcatcaacggcggcaaacggtaaatggcatcaagtgaaaatagactggaagaaggataaccggggaggcggcacgctaacttatactgtcacggttcagaaaagcaatggcaaaccctatgtattttcagagaaagtcacttggacaagtgctgatattcaaaactactttgcccaaaatgcaggcgatccggttccgcggcgactctatttaggcttcacggggactaccagtaattactatgaaccacatgtggttgctatcggtgctttaccggaagtggcgaaggttaagggaacggttgcgttaatgcgaggcgcggaaacagttgatgccaacacgcatttgaaggtagaagatgccattcattatgattatgtggtggacgtccaagcaactaagcaagcagcatggcctaccaatggcaccatcaccatggatgtacccaaaggacagtattttgattatctcaaagcagatggaacgccggcgcaaccagacgaccagcttccgataacgcttacgattggcagtcgcacggttaccgttcaaggaaaagtgcaaagcgacggcaatcggattgtcgttacgcaaatgccgtcagttgcggccggaaccgcagccaaattgcaattttcgctaccggcgcgggtaaagcatcacgccttgctgaaatcgacgctgtttcatgataaaccaatcggaacggtcagtggcgacgggcaaacttatgatttaaaaacgcctaccggtaaagatgtgttggagtatatccttgatccggaaaccggtgatttaaccctggaaaaagtgccgagttttatttttgaactcaaagatggcgcgggtggttatcgcaatccgaacgtcatggacatggtgaacggtattcctaatcccgatacggcatccccgaatcagttagaaacaggccagtggttgaccaatcagcatggactggagtcagccaactcgacagggaaagtgttaagcatcaaggatacccgaccgaccaagcaaggctggcatttgatgatgcaactgacgccgtttacacttgtcgggcagccgtatgttttaggtgatcatggtagtcagcaaggtggcaaagcaacgctggtcttggcggatcgaaccgccaccggaacggacaaagtggctacaatcagagataacaacaatgcaaccttggtgaagaatatggcagcaggcggtactgattggacattaggcgcacaaaccggcaatattgcggcttatctaggcattgaacaaactgctactgctaaagccggacaatatcacgccactgcaacctggttattaagcaacgctcctcagtgagtcgggtaagcagcgctgattataaaaaaggatcctgatcgtcagtggtaaatcactgcagatcaggattcttttatatccgatatcaagttgctttttggatacggctaaacacttttctttcgcgaaaactgccgaattaagcggcgttgcacatgttgcaacttattaaacggcagggcttgcaacaaggtgtttaacacgataagaaaaccacccagccactctgccggaccaaacgcaatgtgcaagcgggtgactgctagtgtggtggctgtcaatggctcaaacgcgctgagcatgcccgttgcgactggtgaaatgtaatgcaggctgcctaagacgagcaagtaagcaagcatagtgccgaaaattacgacaaaggcaatggcaccaagattaggcaatgtcagcacagggttgcggcggagtacatactggggtaaaaagggcaaacttccgagcagcatggaccagccggtgactgcccgcgcgtcatatttggcaagcaaagtgcgaggcagcagcgtgtacaacgcttgactcacgccggccataattccccagaagactgcagccggtgctagactcagactggtgagccgtccgcgcgttaccaacaaataagtgccgatcagcgcgagggtaatactcacgaaatcaatgcgccgcggcatttggcgggtagcaaatgcaacatagagcaagataaaaaccggccccaggaattgcaggatcgtggctgtggctgcatttccggcactaatggcgagaaaataagtcagttgggaaggcaccatacccagaaaggcgaagagaattagcaacatggcatcatgccgatttttccaaatagtgcccaattgccgtaagtctttgagcgagctccagataaccagcaataatccggcaaaaaataaccggataccgactagccataacggttgcaccccggcatcggtaaataacatttgggtgaatataccgctagcaccccaaaagatggcgccaacaacagcaaaaatgacgccttttagtttctgatcattttggttcacgaggtgggtttcagtgcgcgacatggcgggtttcctttccaaaataaactatccagaccattctacgcaaaaagctgctacttggctagttcgtgccttgttgatcaaactttcgaataagccaacctttaaatcaagccattaaaaaacctcgcaaacacgtcaagcgcatttgcgaggcaggttcgttagtcattttcagtattaattctgagctcatagcgtaagttggtccgatagaaatggccgaggagtgccccgatagaagcgcctaaaataatgaggcatagcgggaagagccagctggccagaaagccgccgatgaaaatgacggccattgccgcaatcaggccaatggcgatgctgacacacccaaccgcaccaccgctaaagttagcgttggcagaatagacactggcaaatggaaattggccgccaaccagtggccagcccatcatgagcgtgaagccataagtcaacacgatcacactaatgccggccaacaaggataaccaaccacccatgatggttgtgaccaaggtgattagcaacagtggcggcaggaagagtcgggcgaacatggctttaaccacgccgcgtagtaataagccgtgggttgtgaacggaacgtattggaaaaccgccatcgcttttggctgacttgagaagcgtaagttaaccagcgcaggagctaatgccacgatcacgcccataccggcataagcaatatagtgctgggcagttgcaaacggcatatcgcgaatctcggtactgataaaaatcagcggcagaataatgccatacgccagctgcgggtaaacgcgtaacttgtaatcacgttcgctaccaagcacccgccagcctagtgtgaaataagttcgctcatccccgggccgggtcattaaagtactaatgccgcggaaccaccaaccaagtttccgggtacgtgaatcgccttgattcaatttttccagataggactcgaacgcgccagaataatgtaagaagacgagtgtgagaacgccgggaacgacgatacttaaaatggttaatacgatacttaataaattcacttggtcagcaaaaagcatcggcagtccggcaaaccatgctggcactgctagcaagtatacccagctgaattcaggaacaagtgacaggttgactgacgacattccgcgcggtagtaaattaggtaattggcctccgacgtaaatcccgatcatcaagagaatctggactaagttgagcatgttgcgtaatcgctcgccatcgaaatagcgtaacaccagtaagtaaacaaataaggcgatcactaaactgaggataccgcttagtattagcgccaacagcccacccacggctactagtggtccaaagtgaagaccagtgacgacaattccgggaatccccattgctaataaggtgatgcccagatagaagcaaacattaaggatgcgcgcaaaactcaaagtgcgatcattgaccccgcgtgaggcaaaaacggttcgatcacgcggatcaagaattaaactcgaataagtggttaggatgttcagaaaacttgttagcagttgaacggagaaaaagattgtgaacaatgtcaaagccgaggccggtagaaacatcatcaggccaataatgaccccgaaaagcagattccagagaaaaccggttctcaggctggcatccttaccgcgcttacgctgactgaaaagactgcccatgccacttggttcgcgagcggccagtaaatttttggtggccaaaatgagccgcaactgatcaaattggacaccgcgtttttccagcgccggggcaaagcgatttagccaggcaaacactttgggtaatggcatggcggctgtgttgaccggttcggcttgcgttttattcagccgtttcattagaatcaccgcctgtcacaatatccacaaaggtctgggctttttgaccatgctcggcaaaaccggtcagatcgttaaacagctgttgcaggttggtatccgcttctttagcaagggtcttaaacggtccatctgcaaccaccaccccgtcattaagcaagatgatgcgatcggacaatttttggacaacatcgagaatatggctggaataaaaaattgtcttgccgcggtcgcgcaggttttgtaaaacttcttcgatgacgagcaccgtattggcatccagaccattaagcggttcatcccaaaaaagaatatccggatcatgcaatagactggcaatgatcagcaccaattgacgcatccctttagaataagaggaaattcgccgatcgaatgcatctttcaagttaaccagttctgctaaggcaaatgctttttgctcggcatcggcagcattgagaccatacagttgcccgatcaggctaagatattcacgggcagtgagcgcatcgaaaacatcggcactttccgggacatagccaatgcggcgtttgtaggccgtcgcattaggcttgagtggttgaccgaacaattcaatcgtaccggcatcaggctgcagcaagcctagcatcattttaacggtggtacttttgccggcgccattaggaccaatgtaaccgacaatgttgccgggggtaatcgagaagctgagatccttgagaacctgtttagcgccaaaactttttacgatatgattcaatgaaacaatgggttctgccatcataatggcctcctttagtcgggcgttgttatgtatgtatgtcatcggcgttagtcaatgatgtgatcgaaaatggtacggcaatgcttgcgctgattatgacagaaaaaattatgcttgtataggcaaacgacttatttataacgtatttttcgggtataaaaagaacaccgctcagattcagcagtgttagataaacgcttagacttctggactagtccacaataaaggctgattaaagaacataaacgagcttaactattaaaccgtttgaatagtggacgaagcataaagtacaggataggaacgataatcgctgtggcaatggaattgatgaccgttgcgggaagacttaaaaaggcgccaacaaccgcggtttttaagatggttccgaccatgagtgcttcgacgataccggttaagtaagaagtgacgattttggttagcccggcaacaatggcaatggtgataatatactgcggcttgtcctgatgcttgaaagccttaaccaacgcactgacaacaatggccatgacgattgcttccaaggcagttagccatgaggtggcagcataaccattaagcaaatcaaaaccaccaaggccaaccacagccgcaaatccgccaagccgcccaccaagaaataaaattgcgagcaccatgagcggattgccaaagtgaataaacggccgcccgaccatcgcagggatgggaatacgcaaaagggagatgccgatgtaaatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaaataatggcagcaaataagccggtaaagataatgtttttcaaggaatgtcgtgaaacttgcatgggaaaacctccaaaaaaagtgagcgcgagccggcgcgggagaaaccggagtgtaagtggcctcaggcgtgatggccggtctttggccattgcgaccaaggtccttatacgcagattcctgcgccggggagtgcgttatagaaagcaaaaagtgtgccaacgcgttcaggaaacggaacataggagcataacggctagggcacttattaaatgcagactcctggcctaggcagcgcgttatggtgggatctagtttataaaaaataatgccacaatagccgaaatctctacggcagttctttactaatagccgaaacgaccccagttaaattcaagccatatttgggattggtattcgtagccaaagtggctttaatggcaatccgcgcggcaatcatggcgatcgctgcagcttgacgtaaagtttgtccttttagcaaggcacttgccaaagcagcggcgaaaagatcgcctgtgccgaaataatgcccgggttcttttggctgagcgagtgcaagtgagccgccttgtgcatccaccccgataacggccacttggttatggtatggcacgccggtgattacgacggcactgttgaattgggtgtaaagacgtctggccaaggcgctcaccgttttaggatcggtaggtgcggttaaaggttcatccagcagtagttgtgcttcggtcacatttggggttaaaacagtggctcgctgcgctaattgctgcatggtagcaacatactgtgaatcaaagcctttataacgtttgccatcatcgcccatcaccggatcgatgaggacgaggtgagattgaaacttgggcagccaacgttcccattgatcagcagcgccttggcccaagtagccgaggtagatcccgtcaggatttagttgcagctgttgccaatgtttgagaataccgggcatttccgaactaagatccagataggtattcgcgccgagtccgccagtgtggctggaaagcaaggcagtgggtaagacatacggcgttaaacccaagccggccacaagtggcaaggcaacccccatcgaaacctgaccgacaccgcaaagatcctgactgataacgatacttttagtcgacaaatgaatctcctttctttttaactagttgttaactttgagaatggcgaaattatggcaatttgtcaaatgaaatttaatcattctttctggtctcacatcagcattcggctaactggagaatggcaaggtttggtcaaaaatcatttggactgtgcatcgatcctgagtcattttgaaatgaaggttgtttaaacgttttcccgcttgcgcacaaaacccgttttctttgcgtggatttagctgaccacggcaaagaaaacgggttgcagagtgtgtgctcttggaagattaagcattacggatggtctgagtagcggttgcaatgcgtttaacgacggtcgggttgtccatcgtgtaaatgtgaataccatcgacgccatggaccagcagatcaatgatttgatcgatggcataggcgataccggcatcccgcatcgcttccttgttaccggaaaaatgctgcatcatggcgacgaacttcgggggtaagtgaacacccgccattgttgccatgcgctcaatttggtgttcattaatcaccggcataatcccggcttcaatggggacattaatgccggctaatgctgcccgctcacggaattgatagaaaacctgattatcgaagaaaagctgactaatcaattgactcgctccggcatcgactttttcctttagatggcgaatgtcgctcacaacgtctggtgactcgggatgcttttccgggtaacaggcgccgacaacgtcaaagtcgccaacttggtgaatgtgttcgattaaattgcaggcataagggaagtcttcactgacgcgtccggacttggggatgtcgccgcgtaaagccaagatgttgtcaatgccggcttcctgaaacccacgcagctcagcatcgacttgggcgcgggtgagttgggcagcaggaagatgggcaacgggttcaagattgaattcattcttgatcaacttagccacttccaaggttcccatgtgcggtttgttgccactagcaccaaatgtgacggaaacaaagtccggatcggcggctttaaccgcgtccagagtgttgaggatggggcgcatggcgatgttcgtcgcatttttacgcgggggaaacacttcaaatgagatgacttgatgatctttaaagcactggctgattttcatgagtaagttccttacgcacttgtttagcagcggctaccatgttgatgaggctggccttggtttcagggacatcgcgagtcttgaggccgcaatctggattgatccaaacgtggtcagcaggcagccgcttgagaatttcgtggataatatgcacaatttcgtctttagacgggattcgtggagagtggatgtcgtaaacgccagggccaacatgagtctggaagtgggtggcttttagaatatccaaaaggctaaagtcggagcgggccgcttcaaaggagattacatcggcatcgagatcatcgattgctttaatgatgtcgccaaattgcgaatagcacatatgggtgtgaatctgggtttccggttttactttgctggcaaccagccggaatgccggaactgcccagtccagatatttcggataccagtcttttttgcgcagcggtaagttttcgcgtaaagccggttcgtcaatctggatgattttaatgccatgtttttcaagatcaagcacttcatcttccaaggctaaggcgatttgttctacactggttttttgacttaaatcttcacgcgggaaggaccagttgtaaatggtgactgggcccgtgagcatgcccttgacgagatgatcggtttgactttgggcaaagacggtttcggcaacggtaatcggtttggtgcggacgacatcgccccagataatcggtggtttaacgcccctggtgccatagctttgaacccaaccattatcggtaaagcggaacccgccaaagttttcgccaaaatattccaccatgtcgttgcgttcgaattcaccgtgcacgagaacatccaggccaatttcttcttggaatctgagccattcgatttcttctttgtggttgaaggcggtgtattcgtcttcggtaatttcgtggcggcggaacttggcccgattgcgccgaacttcagctgtttgggggaatgagccgatggtggtcgttggcagcagcgggagtttgaattcttttgcttggatagcaagtcgggttttgcgctcaggcgtgcgtttgtaatcttccggcgtcaaagcggcaatcttggcattcaaggctttattttcctgataacgcggtttactgaaaagggcaacgttggcttgataagcagcatgatccgcgccggtgtggaaaatggcatctaactcatgcaattcgttgagtttttcttcggcaaaggccaaatattgcttttcttcaggtttcagatgggcttcattgcgaagtgtatatgggacatgcaagagtgaggtcgaggtgcttaataccagcttgtccgtaatagttgccaattgtttgatcgttgccaaggcatcggcataatgtgtccgccaaatattcttaccattcacgattccggcaaataaggtggcgtgcgctgggaagccgtattgtttgagcagatcaagattggcatatccttcgacaaaatccaagccgaagccgtcaaatggcagtttctgaatacggtcaaacgaatcggttaaatcgccaaagtaagtctgaaccaggattttggcagcctttttttgggccaaaatcggggtataaagccgctcgaataaggcgaggtcggcatcggtttgatcataaaccagcgccggttcgtcaagttgtacccagtcagctccagcttgatgcaagcgatcgatgatggtcgtgtacgcagaaatcaggtcggctacaaagtcatcaggcacaacatcaatgaagcgagacaatttcagtaacgtatacggtccaatcaaagtcgggcgcccgttaatgcctagcgctttagcttcttcaaattgcgcgaaaagctgccaatccgttacttggatcttggtatcgtgatcgaattcaggtaccaagtaatgatagttagtgttgaaccactttttcatcgccaacgctttaacatcgccggcctctccttgatagccacgcgcttgggcaaagtaggtgtcaagcggtgataagttcaggtcttggtagcgcttgggtacaatgtttaaaagatttgcaacgtccaaagtgttatcgaaaaatgaaaagtcaccggttggaatctgatcaattccagcagcttgaatggtttcccagtgagctttccgcagtgcttgagctttttcctgcaagtcttgggcagaaatttgatgcttgaaatatttttgggttgcaaatttcaattcgcgatgttcgccaatgcgtgggtagccgataatcgttgttgtcataaaaatcctcccaggtaaatgagcgtgagccggtttctgcaccggtgaacgcgttaaaagtcagtgctgtggaaacgaatactgatcagctgtgcaaattagccaaccatgtcagcttttatcaaaaaccttgccaaaagatgcggtcacttaggcgtacggcacatttgaaaacaaaaaagccgtccttagcccagacatagcttgtctgggccaaggacggcttaccgtggtaccaccttggtttgaaagctgctcacacaactttcctcaatcagtccgacagtattcactgtgagacctaacgcaataatgggcgtccccatgtgtgctttgccattgctcggcacacctgcatcaccaagaccatattcgctggcatttttagatgtcctttcaccaaaatggacactctctaaacaaaaaatgaacagctactcatctttccgcatttcaatgttgcgactagcatactgacaattgtggtggttgtcaagttgtttattagttatgtaagtgtcaacttttcttggttctactctaattaagtgatttccgatactccgagctggctccgcggtggtggaggctggcgaccgcgcagctagagcggtgggcacgactttgaacccgcaaaatgcgcggtttcaaagctcggccttggtctaaagcggagaagatcactccgcttaagaccaatttcacagctgagcccatcgccgctccgccagctcttgctttctatcgtactattcgaacatggtgaccactcacattgctgttggaagttcttaattgatactcaaattgataactatataaccgggcatttaccctgacttgtcttccattttgcggtaagctattaggacaagtcatcggaggaaaaagaaatgaaggtactatttccatatatcaaaaaatatcgttgggacgcgatctggtcggttgtcgcgatttttgtcgtggcttttgcgacgctttggcagccgcatttgttgcagattatcatgaatgccattatgaaaaatgataagcaaacggtctgggtcaatggcctgtatttgattgggctagccattgtcggcattgttggcgggattgtcaacacgatctattcggcacgtgtggcgttaggtgtggcgacggatttacgcgcagacgagtatgccaaaattcaaagtctggcttatgcggatgtggagaagttttcaccgtccaatctggttgtgcgcatgaccaatgatatcaatcaggttcagcagattatcatgggctttttccagcaggttacccggattccgattctctttattggggcggttattcttgcgattgtcactttgccgcaattgtggtgggtgattgccgtgatgatggtgctgttgtttggcgtcagcttcttttcatttagtcatatgggcaaatactttggccgtatgcagcaattaattgagcgggtcaataccttggcgcgggaaaacttaatgggcatgcgggtggttaagtcatttgtgcaaggggctaaccagacgaaaacatttgccgaatcaagtgacgaaatgcgcgatgtcagtgttaagatcggtaatctgtttgcattattgatgccagccttctttctggttgccaatttagccatggcgttgagtatctggcttattggccaaaatattaccagtcagccgagcaatttagcggccattaccagttttatcaactacctgatgcagattttgtttgccattatcaacggcggatttatgctgacgtttgcatcgcgggcgctggtttctttgcggcgaattcatgaggttatggatactaagccaagtatgacgtttgtcgatggaccgcagcgcgatttagacggatccgttgagtttgacgatgtgacttttacgtatccaggtgatgaaaagccgacgattcgagatatcgattttgcggttaagccaggggaaatgattggcatcgtcggggcgaccggtagcggtaaaacgaccttggcacagctgattccgcggttgtttgatccggataccggaatcgttaaagtcggcgggcatgatgttcgtgccgtcactgaaacggatttgcgcaagacggtcgggtatgtgttgcaacgctcgacgcttttttccggcacgattgccgaaaatctgcagcaaggcaatcctaatgctgacttggcagcgatgaagtgggcggctcgggtggcgcagtcggctgaatttatcgaacggctgccgcagacatacaacgcggaagttgaagaacggtcgtcgaatttttccggtggccagaagcaacgcctttcgattacgcgcggggtgatcggtcatccgaagattttgattttggacgatgcaacatcggctctggacgcgcggtcggagaaattggttcaagaggccttggcgcatgaattgaagcatacaacgacgattattattgctgaaaaaatcagttccattattaaagccgatcgtattctggtgcttgatgacgggcgtttggttggtagtggcacccatcacgaactggtgcagcataatcgggtttatcgagaaatttatgccacccagaaggcattggaagagggggtgtagctcatgaaagacttgaaaaacgcaggtaaattttacgcgcattatttgcgaccgtattggttagaatttttgattacgacgattttaatcgcgatttctacttgggcgattgttgtcgcgccgacatatatggggcgggcgattgaagaactgaccgtttatgtgcaacagtggatgaatccggcgactcgcgcccaggcatcgtttgcggcgtttaaccacacgttggctattttcgtcttactgtatgtgattgatgcgacctctatcttaatttcgagcttactgttgtcaaaaatcagcggttattccactggaacgatgcgggttggattgtttcggaaaatgcaacggatgaaagtgcgctattttgacagtcatagtgatggcgacattctctcgcggtttacgagtgacttggacaatattttcaatgcgatgaatcaggcgttgattgaaatctttctaagtggcgctcagtttatcgggattatctggatgatgtttacgcagaacgcgacccttgcgtggatcacgatggcctcaacgccggtcgcaatcgggttatctgcctacgtgatgcatcaggcgagtgtgtcggttgatcgccaacaagacgatattggccgactgaatggctatatcaacgaacaaattaccggccagaaaatgctgattacgaatgggttgcagcaagaaagtgtggcgggcttccaaccttataacgcggcggtgcgcaagtcgaatttacgcggccagatctggagcggcattttgaatccgttgttgatgggtttgtcgttgctgaatacggcgattgtgattttcgccggatcttggctggcgctgaatggctccttgagtcaaggggctgcgttggcaatggttgtggtgtttgtcaattatgcccagcaatattatcagccaattgtccagttgaccagcttattcaatatgatccagttggccatcaccggcgcgcggcgaattaccgaagttcgcgaacagccggatgaagtcgatcccaaaaatggccgcacccttgatggtctgaaacatgaactgctgattgataacgtgcattttagttacattccgggcaaagaaatcctgcacggggtcacgatcaaagtcgaaaaaggcgagatggtggcgttagtcggtccgactggcagtgggaaaacgacggttatgaatttgttgaatcggttctacgatgtggattctggcgcgattacttttgatggcgtggatgtacgcaattttaaattggcatcactgcggcaaaatgtcgggattgtgttgcaggatccgcagctgttttccgggactattcgcgataatattcgcttcggtgatccgactgctgatcaagcccgggtagaagcagccgccaagcaagcgaatattcatgacttcattatgagtttgccagatggttatgatacgtttgtgtcggatgagcaaagtgtcttttctgccgggcaaaagcaacttatgtcgattgcgcggactattttgactgatccgcggctattaattcttgatgaggctaccagcaatgttgacacggtgaccgaggctaagatccaagcggcgatggataatgtgattcagggtcgaacaagttttgttattgcccatcgactgaagacgattctaaatgcagacaaaatcgtcgtgttgcgggacggccgaattattgaggaaggcgatcatgaacaattgttagcacaaaatggcttttatgccgagttatatcacaatcagatggtctttgaatagcagctttaagactccgaacttttttggagtcttttttattatcattcgtatatgaaacggttacggtggctatcttaaattcaaatcttatgatacgcttgttatatcagaacaatggtcggcattgaactgataaaaaagcatcgtggaggtaaccaatgagcaagcgtagatatttagtggcacttggcggtattttgttgcatttgatgatcggctcggtatatgcgtggagtgttttcaccggtccaattgctaaacaaacgggctgggcattatcagcagttacgattgcgtttagcattgccatcttttttctaggtatgagcgcggcgttcatgggccgactggttgagcgctttggaccacggttgacgggcactgtggcagcgctcttgtatggctcggggattttgctaaccggtttagccgttcagattcactcgttaccgttgctttatatcggttatggtgtgattggcggtctgggcttaggtgccggttatgtgacgccggtttcaacgattattgcctggtttccggataagcgcggattggcaaccggcatggcgattatgggctttggatttgcggcgatgctgacgggtccagttgcccagcagctgattgcaaatctgggtgttgtcgcaacaatgtatgttttaggcgcggtttatatggtaattatgctgggatctgcacaggtaatccgcaagccgcatcctcatgaagtaccggcagccgatcttgccaaaagtgtgagtctgaccggaaaagctatgacggcgaacgaagcggtcaaaacccgatcttttcggtatctgtggctgatgttttttattaacatcacctgtggcattggcttagtggcggtcgcatcacccatggctcagcagcaaaccgggatgtcggcaaccacagcggcagtgatggtcggtgttgtcggcttatttaacggtttcggccggctcgcatgggctacgttgtctgatttaatcgggcgcccactgacttacaccctgatctttatcgttgatgtcgcgatgctggcaggtatcttagtcttgcgttcaccactgctttttggcatcgcactttgcttgataatgtcgtgttatggcgcgggcttctcggttattccagcttatcttggcgatgttttcggtaccaaacaactcggcgccattcatggctacgtactgactgcctgggcagcggcaggggttgccggaccaacactgctgagctttagcgagcagtacttccacaattatagtgtcagtttgatgatctttattgtccttgaactgattgccttgggattgtcgattcgtattcggcaccagtttgcggacacccaagttaaggatgttacggaataaagtttggtagtcatgacgtacaggttaacttaaggcattaaaagatggttaatggaaaaggccttaagagcgttttcgatgatgatacttaccgtatatataaaatcatatgtatcgaaataataagcaaaatttgatccacacacaaatgtggatctttttttggtttaaaaacgttgccatataagcattgtgaagcttttctacatttaaatttaagctttcaagcgttttttgttgacatacctgtacgtacaagtagaataagcattgtaagtgaaaacggttactggaggaaaaacaatgcgcaagtacgatgctatctatcaggatctgaaggataagatcgaagcagaaatatatgctaccggctcattgctgccaagcgaaagtgcgctgcaagacatgtatcaggcatcacgtgacacggtacgtaaagcgttgcggctgcttaaggatgatggctttattcaatcgcaaaaaggcaaagggtcaacggttatcaaccggcaggaatacgtgtttccggtttccggcgtggtcagttatgccgaattagccgcgcaatttcacttacagacgcgaacggtggttttaaccaatcactttgcaacattgccagccaagtcgttcaaagatgtggatccaacggtagaagtcaaacagatgcgcctactgaagcgggtgcggtatttggaaaatgagccagacatcattgatattgattacctcgatcctaaagtcgtgccgccgattccggagtcggtggctaaagactcactatatgcttatcttgaaggaccggtggggttgaccattgcctatgcaaccaaggagattacggttgaaacggcaacggaagaagatcaacggtatctgaaaataccaccatctgcagtcgtggtcgtggtacgcagttgcagcagtttgacggacaccacgaagtttcaatatacggaatcacgtcaccgggcagatcgttttaagtttcatgattttgctcgccggatccgaccgtaaacgctggcagttcttacttttgttaaaagcaaggacaaggaggttatgatggcgtttcataagaaagttatttatcagttatatcccaagtcgttttacgatagcgatggtgatggtgtcggcgacttacgcggcatcattgaaaagatcgattatctcaaggcactgcacatcgatatgatctggttcaacccattctttgtgtcgccgcaatatgacaacggctatgatgtggctgattatcggcaaatcgatccgcggtttggaacgatggctgattttgaagagttggcgcaaaaacttaaagctgccgggatcgacatcatgttggacatggtgctcaatcataccagcacgcaacatgtctggttccaaaaagccttagctggcgacaagcactatcaggattattactacattcgaccaccaaagccagatggcagcttgccgactaactgggaaagcaagtttggcggtccggcttgggccccatttggcgacactggcaattattatttacatttatacgaacgtcgccaagctgatctcgattggcataatccagccgtccgtcaagaagcagccgctattattaatttttggcgcgccaaaggggttcacggtttccgctttgatgtgctcaacgtcattggcaaggcaaatcagctggttgatgcgccaccggaagtcgaaagcaaaacattatatacggatacaccgattgttcaggattatatcaaggagctagccgccaacagttttggccaggatccaaatagcgtcacggtaggcgaaatgagttcgaccaccattaagaactcaatcgcctataccaagccggaaaatcacgagttatcaatggttttccaatttcaccatctgaaaacggattataagaacggtgaaaagtggagcaaaatgccgtacgacttcaaggcactgcgcaacattttgcacacttggggtcaacagttagatcaaggcggcggctggcaagcgcttttctggaataatcacgatcagccgcgtgcgcttaatcggtttggtgatgttggccaatatcgcgttaaaagtgccgaaatgctagctgccgcgattcacctaagtcgcgggacaccatacatctacatgggcgaggaaatcggcatgaccgatccgcattatcattcgatggccgattatgtcgatgttgaagccaaaaatgcttatcaggcattactgaaagcgggtaagtccgaacaagaagcgtttgccattattgtggccaaggcgcgggacaatagccggacgccaatgcagtgggatgacacggccaacgccggatttaccacaggaacaccgtggttgcggccaaccaatcagcgcgaaattaatgtcaaagctgagctggcgcatggtgaaattttccgattctatcaaaaattgatcgcgttacgcaagcagtatcaagtgatcagcgatggcagttatgtgccttttgggactgaaattgatcgcttgtacgcttacgaacgagttgctggcgatgtccacttgctggtactgaataatttcagtgataaagccattacggtaccgctaccgccacgtttccagcatgcacgcgttttgataaccaatgaagcagatttaacaccaactgcaaccatgacgttgccaccatacgcaacgattgcattgttgcagtcagataagggggaataagcaatgacaaagaaattgcacttaatggcgccggtttccggattggcgatggccattaccgatgtttccgatccagtcttttcacaaaaaatgatgggtgacggttttggcattgagccaaccgatggccaaattgcggcaccggtcgatggacggatcatgatgattgccgataccaagcacgcaatcgggatcaaagccgatgatggcgccgagttattaattcatttagggattgatacggtcgaactcaaaggcgcgccgtttgaaattgatacggcgatggatgcacgggttaaagccggtgatgtgattgggtctatggacttggatgcaatcaaaaaagctggcaagaagaccacggtcattgtcgcgattaccaacacgaaggaagtcgttgatcagctggacgtgacgcccggcgaagtcaagcgcggcgaagaagttgcggtgatgacacctaaagcggccgcggttgaacaagcaccggcagcaccgaagaacgaaagcaaatatgcggccacagcgcggcaaatcattgcggatgtcggtggcgcccaaaacgtcaacagtttgattcactgtatcacgcgcttgcggttctatttaaaagatgaacaaaaaccggatgatgacaccgtgcgtaacattccgggcgttatcgatgttgcgcgggcgaatggtcagtatcaggttgtcattggccaagccgtgacggatgtttacgatgaagtgattaaacaactcggccccggttattcgaatgcagaaggaactgccaaggccattcaagaaacccaagcggaggcaaaagataccagtgcgcttggtacgatcaaacgctgggcgcaagcgttgatcgggacgattaccggttctatgattccagttatcggactcttagccgcaagcgggatgttaaaagggattttgaacattttaacaacatggggcggtctgaaaaccacaaatccaacttatgaaattattaatgcgatgggcgatgcagccttttacttcttacctgtcattgtcggcttcaccgctgcccagaaactcggatcggatccggttattgtcggaattatcggagcgttcctgatttatccgtcaattgctaaaatcgccactgctggcaaagtgaccggcacagtgttaggcatgggcatcaacgcgaacttcttcggcttgccggtgcacattgccaattacacgtattccattttcccgatgatttttgcagcgtggatggcggcaaaaatcgagccgtggattaagagttggatgccgctggtactgcgcatgattttcacaccattagtcgaaatcttcttggttggtatgacagttgtcttggcggttgggccactgatcacggttctgtctaatggcatcacagctggtattcaggcattactcagcttaacgccgatggtttccgatgccattatcgccggcttctatcaagttctggttatcttcggattgcactgggccgtcattccggtcatcaccgcgcaattgtcatcggcacatcccgagtccgtgctgaatgggatcgtatccatttccatgattgcccaaggtgccggtgcattggcagtctgggttaagaccaagcacaatccggccttaaaaggtctgtcaatttccgcctttatcagtgcttgctgcgggattaccgaaccagctatgtacggggttaacttgaaatatggccgtgtcttcatcttttcaagcatcggcgccgcaattggtggcttggtcaacggcttattaaatgtcaacatgtacggttttaccggcagtttcctaggtgcaccttcattcgtagcaccaggctgggctcacaatccgaacaacatctggtttttctggattgcatcacttgtcactttggttgcagcattcacactggtttacctttttggctacaaagatgcggatgcgaatgccgcaaaagcagcacctaagaagaagcgtttaggtaaaacagttgaataatatttgataaggttaagcatgtgttcacttgagtaatcattcgtttgatgacgaaaacatggtttaactttggtcttaagtaaaaacaccgatgccattttgacgtcggtgtttttgtttggattgatgaaagtcggactaacaaaagatttgcagtgttatcgataaaaataacttgcagttggtcaaagattcaggcacactaagaagtgttctcattaaatattaatttttatatggaggaggggccagaaatgtataaacggtacaaagatgtgtcgctgattctgaaaattgtgatcggaatcgtggttggggcagtgttaggggtattggtgccctcctggtcctttatcgatgttttaggcaagctgtttgttggcgcgttgaaggcaatcgcgccgttgcttgttttcttactgattatgtccgctatttccaaatatcgctcgggatcgaaaaaccattttggcactgtcattgtcctttacttaagtgccacatcactttcttcggtggcagctgttgtcgtttcgtatcttttccccatcaagctggtgttaccgggggcgatgaagattgccgaaagtgcgcctaaggatttaggaacggttgtgaccgggttattgaccaatgctgtggcgaatccgatttcagcgttggttgaaggtaattatctcgctattttgttctggtcgttgttgatcggctccggtttacgtttgacgagtgccacgaccaaaaaagtggtgaccgagctggcagagaccgtcagctcagtagcgcaaaatgtcatccagtttgcaccgtttgggattgttggcttattgcatgaatcattgagtaagaccggcgttagaggggtcatggcttatggacaactgctgatcttgctggtggcgactatggtgtttgtctatctggtcgtttatccgttcatggtttggttgctgacgcggcaaaatccttatccgctgacgttttggacgttaaaagtcagtgggattccggcctttttcacgcgtagtggcgccgtcaacattccgattaacctcaaagcttcggaagatttgggcttgaataaagatagttatgctatttctattccactgggcggctcagctaactctggcggggcggccattaccgtgtcgattatgaccttggccaccgctaatacaatgggcgttcatgtcagcattttcctcgccttgttgctttgtttcctgtcagccatttcggcaaccggcgtatcgggcattgccggtgggtcattgctcctgattccaatggcggcttcgctttttggcatttcaaatgatattgccatgcaggtcgttgggattggttttatcatcggtgtcgtacaagactcagttgaaacggcggttaactctgcgtcagatttactgttcacggccacggcggaatacgcggatgatcggcgtgaaggtcacccggttaacatgcgtgctgctgtgaaggcggcaggcaaacagaagcttaagtccgttgcgcctgtggcagaagatgataaatgatcagcagctacaaatgttcatgaatgcttaccctgttgataggtgccatgcatcgttaataggcaaatggaaactggctaagtgagttcagaccacgcttaggcagtttttgtttgcttaaaaaagcttaagatttggcggctcatcattccggaaacttggctggcgagcattcaatgttgtgataacaaatgtcattaaaaacacagcgctttccagtcttactgaaatgtgctaacctatttttcatgggttttttaccaaaatacgtaaaaagagcataaacaagtcaacggaggttccaatggggaaagtatggcaacgattatttcgcaaagaagatccaagtgtgtatgaagacaaagactcgcatttgccgcgggtcttgcgcgtgcgtgattttctggcgctaggcgttggtaccattgtctccgcatcgatctttacattacctggggtcgttgcggctaaacatgccgggccagcagtgtcaatttcttttctgattgcggcgctggttgccggactggtggcatttgcctacgctgaaatgtcagctgccatgccatttgccgggtcggcttattcatggattaatgttgttttcggtgaattcttcgggtggattgccggctgggcgttgttagctgagtactttattgccgtggcctttgttgcgtctggcttatcggctaattttcgcggcttattggcgacgatcggggtgaattttcccgcggccttggcgcatccttttggtactaacggaggcattgttgatttggttgccgtggtggtgatgctgctggtcgggattttgttgtcgcgcggcgtgtccagtgctgcgcgagtcgaaaatattctcgttgtcatgaaagtgctggcgatcctgctatttcttgtggtggggttaaccgcgattcacccagaaaacttccatccgttcttcccggcgtatcatcttaacgcggatggcacaccatttggaggctggcagggtatttatgccggcgtctccatgattttcttggcttatatcggttttgattcgattgcggctaattcggctgaagcgattgatccggagaaaacgatgccgcggggaattttagggtcactcttgattgccgttttcttattcgtttcggtgggactggttttgttggggatgtttccatatcaagattacgccaacaatgcagaaccggtcggctgggcgttgcgccactcaggtcatgcagtggtcgcaaccgttgtcgaaagcattgcggttttaggtatgttcacggcgctcatcggcatggcgatggcgggctcacggctgctttacagttttgggcgtgacgggatgttgccgcatggtttaggaaaattgaatagccgcaagttgccgaatcgggctttggcggtgctcatcactattggcgttattatcggtgcgttctttccatttgcgtttcttgcccagttaatttctgcgggtaccttgatcgcattcatgtttgtcacgcttggcatttaccgtttgcgtccgcgtgaggggcaggacattgccaagccacgttttcggatgccattttacccagtgttgccagcggttgcttttctcggatcgctggtcgtctttctcggattggacattcaggcaaagctgtattcaggcgtctggttcctaatcggttgtgcgatctacttcctttatggcatgcgacactcggcattaaccaaaggctccgaagttgaaaaggagacggaagcactggagcaagcaaagtcggacgagtgaagttgcatgtgaagctacggcaggcaacatgagtgagcgcgtacaggaaagttcatacgcaaagtaaaaatcggcttgacagagacaattagcattctctgtcaagccgattttgattgtcatgcgtacctgctgaaaaaatactgacgatgggttgtgttctaggcttcctgtgccttctttaaattatctttcaaaatggcagcagagtcagccaggcgtttgtggtcttccgcgtttaaatcaagttcgatgatacgttctaagccgtttgcgccgaggataaccggtaccccaatggagacacctgacaaaccatactcaccgtcaagatggaccgacatcgcgaatgctgcccggtcgtcattcaaaaaggcactggtcaggcgggtgagcgaagcggcgattccgtagaaagtagcacctttcttttcaatgatgccatatgcggcagttttaacgcggtggctgatttcagctaaatcacttgcttggcgatttttgggaatccaatcgagaatcggtttgccgccaatattggtgtaatcccaaaccggaaattcggagtcgccatgttcgcccatgatgtagccgtggacaatgcgcgcatccacattgtaacgcaagccgatttccgaacgcagacgggctgaatccagcgctgtacctgagcctagtacttggttacgcggcagccccgattcttccagcactaattccgcgagcacgtcgaccgggtttgaggcaacgagaataaaaccattaaaaccactggccatgatattgtgcgtgatttcttttatgattttggcattgatcgacaacagttccagtcgggtctgaccgggcttttgcgcgatgccagccgtgatcacaatgatatcggcgtatttgcagtcttcataactcgctgcatagatattcttttgggacgtatacggcagcgcgtccgaaagatcctccacatcgccttgtactcgtttctcattgacgtcaataatgcccaggctttgaccaacgccggtcgttaaacagttaaaagcaaagctcgaaccgatagcgccgtcaccaattaaaataatatttccgctatgttgcatcctaaacccctccttgacaggtagccgcttcacgcaacgattggacgatagcagtgtccaaacaatcaaataggtaacatgtatccgatttcattgtaacagaggtgtaggctttcagcttgataaacacttaatctgttatggtcaactttttctcggttctactctaattaagtgatttccgatactccgagctggctccgcggtggtgatggctggcgaccgcgcagctagagtggtgggcacgacttcgaacccgcaaagaccgcggtttcgaagctcggccttggtctaaagcggagaagcccactccgcttaagaccaatttcaccactgagcccgccaccgctccaccagctcttgctttctatcctgatattcgaacaattaaacgacaaaatcagcgtactttcctaggttatgacctgattaatagcctacattaacgcgttaatcatgtctacgtttcaaattcatctgtttgcgaaaaatagacttttcttgtatagtcttctcttgtatgtcacaacaatgaaagaagcgaacttaacatgcaacgaaaactcagtggccgccatatgcagatgattgcgcttggcggaaccatcggcgttggccttttcatgggcgctagtgccaccatcaaatggaccggtccttctgtcttaattgcctatatcattgccggactttttctttatctcatcatgcgggcgttgggcgaaatgctgtacgttgatccggcaactggttcatttgccaaatttgccagtgaatacatgcacccgctttttggctatttaaccgcgtggagtaatatcttccaatttgttgtggtaggcatgtcagagatgattgccattggtgaatacttcaaattttggtggcccgggctgccggcatggctgcctggcctggttgcgatcaccttccttgttttggcgaatctgatttcggtgcgaatgtttggcgaattggaattctggttcgctttgatcaaagtcgtaaccattgtgttgatgatcatcgctggtctcggcgtcattttatttggactaggaaatggcggtcggccagtggggattagtaacttgtggacccacggcggatttttcacgggtggctttacgggcttttgctttgccttgtccattgtacttggttcttaccaaggcgttgagttactcggcatcacagctggggaagcggaaaacccgcaaccaacaattgttaaagcggtcaaagacaccatcgggcgaattcttatcttttacgttggtgcgattttcgtgattgtagccgtttatccttggaatcaacttagcgctttagggtctccttttgttcaaacctttgccaaaatcggcattacctttgcggcatcactcatcaactttgtggtgatcaccgccgcattatcaggttcaaattccggcatttattctgctagtcgtatgctttacacattggcagatgccaaacagttaccgcgaatcttcacaaaactaaatcgccatggagtccctttttatcccgttgtttcggtcggcggcggcattttactcggtgtgcttttaaacgccatcctgccttacgtggcgccagcagcgaaaaatgttttcgttctcgtctatagttccagcgtcttgccaggaatggttccctggtttgtgattcttattagtgaaatcaagtttcgaaaagttcacgccgataaaatgacggaccatcctttcaaaatgccattcgcaccatacagtaattatctcacacttattttccttgtgttcactttatttttcatgttgctgaatccggaaacaagtatttcattagtagtcgggattatctttttaagtttggtgagcttgcattatttcatctattatcgccatggaaacagcaaaacaaagccggtaatggatcaagacaatgacctttaaagctatgtcctgattgcgctgactgcaaatttttcaaactttcacttgccagaccctctcaccttgcatcttttctgacatttttctatgagtgtttttatttcacggctaatttgtataatgaaactgtatgaagcagcctgtgtttgctcatccggaacaagtggcaaacacatgcaaaggaaaggggtttgcttttatgaaaacgatcaatattggcgatgtaacggttccaattgtcggaatgggcacctggtatttaggtgaaggcaacgctgaacaaagcgcacgcgaaacccaagctttaaagtacgggttagatcacggcttgcgggtgattgatacagccgaaatgtatggcaacggcgcggcggaaaccttgatcggcagctttttaggcgattacccacgggccaatatctatctgatctctaaattctatccgtcacatgccgacaaaaagcaaatgcgaacggcgctgacaaatagcttgtcgcgacttaaaaccgattatctcgatctttacctacttcactggcgcggggctaccccactggcggaaacccttgaaggcttacaagagctgaaaaaagagggactgattcgccaatacggggtctcaaacttcgatgttgacgatatggatcagctcactttggaaccgggtggcgagcaagtcgttgccaatgaagtcttgtataacctacaatcacgcggtattgactttgacctacttccacgccagaagcaggcagggatcaccacgattggttactcgccttatggttccggcagcggcaaatccatcaagctaactccggaactcaccgacttggcaaaaagcaagggcatttcgactcaccagctcctgcttgcctgggtattgcgcaatggtgacgtgctatccatcccccgcactggtgaagctagccacatggcagaaaacattgccgcagcagacgtcacattttcaccggacgaattagatctatttgatcaagccttcccgatgcctcgtcatcacgttcccctggaaatcatttagtcaaaacaacgcctcatcccaattactgctgtgttcagtcagcggcgagcgctttcacgtcagcacaaaaaacgttatactaataacaatcattttccaagaaaggatcattgttgtgaaaatttttgttgtcggcccccacggtcaaatcggccagctattggtgcataaattactggatcgaggcgatacggtcacaggaggctatcgtgacccgctcacccagacacccgatccggagaaaaactttcgcgcagttgagcttgatctgtcatggccggtcaatcgattagcagaccttttcgccggtcatgatgcagttgtgttcgctgcaggatcgcggggaaaagatttactcggggttgacttagatggggccatcaaaaccatgaaagccgccgaagccaaggatgtcggccgcttcatcatgcttagtgcacttgatgctgaggatccggcacactggcctgcacaattgcacgattactacattgctaagtattatgcagatgagtggttaatccacaatacggatctggattatgtcattgtccagccaacctcactcacgaatgaaccggcgcaaggaaccattacgctgcagccgcaacgcccatcaaccattccgcgtgccgatgttgccgatgtcttggttgccgcattagatagtgatcgtcaccgcgaaacaattaaaattgccactggcccaacaccaattgaagaagccgtaaaaagttgacgcagcacaaaacacgtggtaattttagtttaactttaaatcgaaagtgaggtctcgtccattgaagaacgccaattgttgaaatgtccaagtcctgtcatcatcaacgggattcgtgtggactttttgacaatcgggcgcgatcaatggcggacactccgtctattttggtcagccttaattttgggggctgaccttttttatctgagcgtgaaccggcgcgcttaggaatcggagtgtaagcggccttgggcgtgatggccgcactttgccattgcgaccaaggtccttacacgcagattcctgcgccggtgaacgcgttatgaagctgagcgtgaaccggcgcgcttagaagtcggagtgtaagcggccttaagcgtgatggcccggtcttggccattgcgcttaaggtccttacacgcagacttctgcgccggtgaacgcgttatggtgagcgtgaaccggcgcgttatcagccagcattttcacgctcatcacaacccgatttcaaaaagcaccgcagcaccacccgtcttgataccacaggcacatcccggaaaggacgtggctgtatgtctaccatccaaatcaaacatctacactttgcttacgatggccaagcaccgatctttactgatgccggtttcgatcttgatacaaactggcatctcggcttagttggccgtaatggtcgcggcaaaacaactttgttacgcctattgcaaaaacaacttgattatcgcggtacgatcaccgtaccactgccgctgcaatattttccccaaggactcgatgaatctcaggtgacattggatgctgctcaggcgtttaaccatgtcgcccagtggcaacttgagcgcgaactcaacttattgcatgccgatcctgcgattctttggcgaccgtttgctgatttatccggtggtgaacaaaccaaagtgcgcttggcgttgcttttcatccagaccgatggctttgcactcatcgacgaaccaaccaatcaccttgatctgcgcagtcgccggcaggtagcagcctatttgcagcaaaaacccggctttatcgttgtgagtcatgatcgcgattttttagatgctatcaccgatcacaccttggccattgaacgccagaaaatcacgctatatcaaggcaactacacgacgtttgcaactgaaaaagcgcgccaggatcaaaccgaaattgcccaaaatacccatttaaaaaccgaaatcagtcggctcaaacaaacggcttatgacaagaaactctgggccgaaaataaagagcgcagtatttacggcgatcggcacgttaaaaatagcggtcataggggtcgcggctttatcagcgcccgcgcagcaagaaccatgaaaaaaagtaaaaacctggaacaccggatgaacaaagaaatcgaagaaaaagaacagctgctcaaaaatctggaaaaagtcgatcctttaacgatgaatccgcagccgacccaccagcaccaattgattgtggcggaaaaggtgcaactcggctttgagcaaccgttattcgagccgatttcgttcaccttacaccgtggcgatcgcattgccattgttggggaaaacggcagtggtaaatcaaccttgatccgcgcattgctgggtcagtttaacggaatcagccgtggtctgttgaagctggcacccgtatctctgagtctggtacgtcagcagtatgccgataaccgcggtacccttccagactttgccgaaacccaccagcttagtcgcgaagcattgctcaataacttacgcaagcttggtatgccgcgcgctgattttgccacgccgattgaacatttgagtatgggccagcaaaagaaagtggaagtggcccgctccctggcaacgcctgcagcgctttacatctgggacgagccacttaattatctggatacctacaatcaagatcagattattgcggccgtccgccaatatcaaccaacgatgctctttgtcgaacacgatgaacattttatcgatcaggttgccacaaagatgattcgcctacacccgttgctataaacgaaaatccaaagctatgcgcgcgcgagccacaataacaccatgttaagcggttccatggtatactcacgatgaaagctcaaagaaaggatggatagcatggcagagcgttctttatatcatacctatgtccgtaacgaaaatggtctggttggtgaaagttatgttgaaggcaaccaaggattagcactgggcgtttccagctcgctcattgatgcgccgggtaccaatccggagcagtttatcgcctttgcactgtctacttgtttcaatgccaccattcgtatcgttcagcatcgcgaaggcaccgcagaggattcccaattacgcacccgtgtcgatatcgtccgtgacaaaatcggctacaaattcattgtggatgcccagattctcatgccaagccacactcgcgaagaagcccaaaagattgtcacccaggctttagacgagtgtccggttgccaaactgttgaaagaaaatgaaaatgtcaccttccgcattgtcgatgaattcactgatgagccaactttaggtgaataagcgcaacgccctcagtaaggtggttcattccttcatcgggtgtcatgaattgaatcgcgccatcccagtttagcgtgaaccagaaatcagcaattgttgatttctggttcgcgtttttttacttttcctacaagaattcacgacttagcgaaactcgcccgtttagaagtttacagtgaaaggtaaacggagggcgtttaagatgaataaatcatttaaccagtcaagtatttatcggtttggtttgccactttgcttaggacttggtagtttagctttcttggcaatcggtatttgggcaaccatcttgttactattcacatctaaaatcacgacagttctcatactggttttattaggtggttggttcgtaatcggctgtatcatcacaggcgcggtgttgttatggcaactagtgcgcaatcctaagctcgttagccgtaacgttcaccgacttcagtggcttctcgggctcattacgatcatcattgcggccatctcgttgccactttcgtatttttgggcggatacaggtgacgcgccgggggttgtgtttattggtctgtttcttgtggcaatgccgtttgcttgttgggttttggttagcgtttggcagtggacgttggggtgaggatttattttttggttttgcggggatcttcagctgcctgtgaaaggtttgagaataagcgataacgcgcggagattggtttcttttgtaggcgattgtttggtttgactttgcgttctataacgcgctctccagcgcagcaatctgcgtgtaaggaccttgggcgcaatggccaagaccgggccatcacgcctaaggccgcttacactccgacttccaaccgcgccggctcgcgctcacacaaaaaaagacccactcagtttcccgagtggatctttttcaacgaaccaagaattaaagcttggtaacgttagcagcctgagggccacgatcagattgttctacatcgtaggaaacagcctgaccttcgtcaagactcttgtagccttcgccgttgatggcgctgaagtgtacgaaaacgtcttggccgtcttcaccagtgatgaagccgtaacccttatcagcgttgaaccatttaactgtacctttttgcatgaaagtgaatctccttttcaaaactaacaacaacagacaaccgtaatcctaaaaaggaaattcatgttacatgatgtttcccgttcaagtattaccatgaacagagtataacacgttcagcaagaaacacctaatttattttcgaatttctggcaaatttatttgcgatcggttaattgccacgagtggtgtagaccaaatcggatccggccaactacatgccttgtgcatacatggcatcagccactttcaagaagccggcgatgttggaacctgcctcgtaatcacctggaaccccatattcggcggcagcatcggcactggctttgaaaatatgctgcataatctcgtgcagctgaccgtcaaccgtgtcgaagccatcgcttaaacgccgcgaattttggctcatttcgagtgcggaaactgccacgccgccagcattggccgctttggccggaccgtataaaatgtcgtcatgctgataagccgcaatggcatccggatcactgggcatgttggcgccttctgccacggcgatcacgcctgcagccttaaagcgcttggcctgcgctccattaatttcattttgggtggcacacggcaaggccagatcaaacttaagcgctgcgtcccaaaccgaaccttcataatatttggcgccgtcaacccgctcggcataagttttgattctgccacgttctacttctttaatttgcttgacagtggcaagatcgatcccattttcatccaccacgtaaccatttgagtcggaaaccgtgagcactttaacccccagtgcttcagctttttgagcagcataaatggcaacattaccagcaccggaaatgaccgcccgcttaccggcaagcgtttcgccattagccttgagtaattcatccgtataatagatcaagccataaccggtagcctccgtgcgcgccaatgagccgccataactgagacctttgccggttaaaacgccgcgttgtgcccctttaagtcgcttgtattgaccatataggtaaccgatttcccgtgcgccaacgccaatatccccagctggcacatccaggtccggcccgatgtatttgctcagctcggtcatgaagctttgacaaaaacgcatgatttccgcatccgacttacctttgggattaaaatcagccccgccttttgccccaccgattggcaaggtcgtcaggctattcttgaagatctgttcaaagcccaaaaatttcacgatacttaaattgactgacggatgtaaccgtaagccgcctttgtatggaccgatggctgaattgaattgcacccgaaagccgcggttcacttggatttggccttggtcatcctgccacggcacggcaaattggatggcccgttccggttcaaccaagcgtccaagaatgtttgctttcatatattcaggatatttttcaaaaacggggacaacggtttttaaaatggttgtcgctgcttccaaaaactccggctggtgcggatcgcgttgtttgagcgttgcgagaaccgattcgacataagctgttgctgaagtcataaatacccacctttctaaaaacggtaacaagtgttgttttaaggttaacagaaaaatggcagtttgataagaattttcttcatgtgccctcagccagattaactgttattgtaaaatttctctcggttaagcgataggaaaggatgataaaactataagtaatagaaagcaagagctggcggagcggtggcgggctcagtggcgcccaccactctagctgcgcggtcgccagcctgccaccgcggagccagctcggagtaacggagatcacttattagagtagaaccgagaaaagattgacacttaccgtttgattaaggcaatgttcgcgtatgactttttgcgttaaactagtaccggaacacttaaatttaagtaggatatgaggaaatattttggataataagctaaaaacatcattaaatgcttatatggcaaagcatggattgaataccaacgccgcttcaatcgcgattggtgtatccgtaccgaccctgcgaaaggcgctgcgtggtcataacgtcagtcgtaaaacgaccgcaaagattgaaagcatcatcgcatcgggaaaagtcccggaagcagcaaagaccacggtaaaacggaccccaaagaagacagctgcggcgaaatcagtcgctaagactccagccgctaagacgcgcacacggcagacgactgccaaagcgccagcaacgaaaccaagcacaacgaagcaagccgcaacaaagacgccaactcgacaggcaaaaacgcaaacgcagccaacaagtattgctgccaccgatcagaatcaggcggccgtacattctcaggaaaattcagccagtccgcaatcaccgcgccggacaaccaaacgagttgcccgcacaacaacgactggccgacaagtgaatcgcaatacccggcaatcaccgtcaaccaatggtgctaacactgcgagtgagtcacagtcgaccaccaaacggccgacaacgcgcaatcatcgtttcaccattcgccagcagcctgatgtcgcaacccagcaagcacaaagcgaggccaacaaacgtcaggcgcaggcagcaaacagtcagtctaccgctaattcaatgagcacgtctgaaagcaccgaccgccgcgaaaacggtgtgcgccataccaagcaacacacaccaaccggaaaaacagatgcaacgcggcacaacagtacaagcgagcacgaaccggttcggcgtgatcggcgcaatgtgcggctcgatcgcaacaaacaaaacggtacgcggcgaccgggacggccaagacagaatcgcttcgctgccaatgctgatccgcaaaattggcaacccatgacgcaatcagcttctacaagcaattcacaatcgcttagcaatcaagatgccagtcaacaccggactcctgctgttgttaataaagtgacaacccacacgccaagcgtcatccgatccacgtcagctgatcgtgctagcacaaacggtagcgctgcaaacagtactagcaatgccgccaatacacagtcagcggagaatcggtcggcgcgcgccaattacggaacgcatgatgaggtgccactggtaaccgggaagcaattacgtcttttcattgatgaaagttttgaagagcatcgaccggatccgcggatgatgcatatgggaattgccgccattttaccggaaggcgacgatgaaagcttagccggtttccggaacgcgctttatccctatggctgggagccaggggatgaagttaaagcccgcggcaaacaggttgatgcattgacgcaactgattaaagctgccaagcatgaaaacatgggcatgtatacggtcttttcacgtaaaacaacttacccggattttgcaccatcaatggaatatctttatccatatatcggagcaaccatccatgtcttgcgtgatgtccataccacatttgatgatattgtgatcatgatcgatcatcgaaatgagttggaaggcaatcagcttgtgatgggcgccgatatcgttagtcgttacttgaccctgtcactggaacggccaattaaggttcggtttgaatttgcggactcgcgtgaacatcttgggttgcaactatccgactttattgctaatgctgcgttgcggttaagcaaagatgagctcagtctgatcgggatcacgccgatgcctgaattaggcatttcgcagcacgatcagcttgttcgccttactttattgggcctgcaacaggttgtcatgggggttcgcgcggaacgggccgcaatgccttccaagcattcccagccggatcggttcatgcagctgatctttgatgcaacctacgccgattcggatctggtacgcggggctttaccggttgtcaaaaatgcggtggaacaactcattgatgtgttaccaaatgctcgtgtcggtcaaatctccggcatgccaaaccaaagctggtacgacatgactgcacgcatggccggcttgttacgctacatcaataaggatccaaagccatatggtaaggttctagccaagattgaaagtgttacaaagacggctgccgatgagcttgaaatggctttagactcaggttcaaagacaaaacggtaaaagagaccgttcgttgagttaattgcaaaataaaaaccggttgtagagaattttctctgcagccgatttttttattttgcaaggggcatattctgaaatgaaagaaaggcaaaatagtctagtcgataaaactgtcctgatttttcaaataggtgatttcgtcaaaggtgattcgggtttggaggcgctgcatgaggtcgcgacttagctttccatccgtaaaagcctgttgaatgaactcgtattcggcatgaaaggctttaagaaacatcgcgtacaaagcatccccgtcaaatgactcggaatggacccggcgatgacgatcacggtagaaccgccgaatggtattaaccgcactgcgattttgaattgtttcaatccgttgcaaatatcgcatgaccgccgtatatccagcctgttcaatgggcaagagatcttcgccgtgagccgcaaattggcgtttccaatagatcggctctaggttgagcggggtggttaaaaaggcgttttgggcttcattaaacgctttatacatccggcccatgttgaacgaaaagcgaaaccggagccaaagatttttccagagtcgttgatccgccgtgaaatcattgagatcaatgaagcggttataataatgggcttcatcgcgagtaatcgtgccgttcatccgtaaggtttcaatggcacttttttccgcagtgatggtgccttcaaaaatcgttcgttgcagccgccgcgaaggattgtcatttaagatcatttcctgagctaaggcatcggcgacaatttgtgcttcactgtgatgttcggtctcatcgcgcatcgcatcaatgcccgccgccagcatgcgccgtaaccagataaattggcgattgcgttttggcggtttagggacgcaaaacggcaatatgatgaccggaacgatgagactgaggagaatctcaacagccgcaatgagaatgagtccttggcgcagggcaaaatggtgaccggcaacggtttgcgggatcgaaaaagccagcgataaagtgatggttccatttgcaccaccgagcatcatgatcaacgcattgcgccatcgatgtttcttgcccattttcaataacgtccgactccagatgaagcgaacaaaggatttggccacgtagatgaaagcaccgatgccaatgagcaagccgaataaccctgcctgcccgcgtaatgcctcaatcacgacatttggcagcgaaacgcctagcaaaacaaaaaccagcccggaaagaacggcagcaatcatttcccacacattggcgctaataatttgcatgcgggcactggtcaaccgcaagcgatcacgctcaacgccttgggcaatccctgcagccacaactgctaaaataccggaaagtgccagttcttcagccagaaaataaaccagtaacggcgtcagcagctgaattccgaccataattaacggctcatcatcaccgatacggattaaccaggctctgagattgacaataaaaatacctgccagtgcgccgaataaaataccgccaaagaaaacaaacaggaagtcgagcaaagcgtcagtggccgagaattgtccggaaatataggccgacagtgcgagatcaaacgccacaatccccgccgcatcgttaaacaaactttcattatttaacagctgcatttgactggtgcttaacggattggcctgtgcaacggcactaacagcggaagcatcagttggggtcacaatggcaatcaaagcaaatgccagactcaatgggatgaccgggaaaagtgcatggacgccgaagcctaagatcacgaccgacacgagcaccaagccgactgcaagtgacacaatattcgtcagtgaccggccgatttgtcctcgtgaggcattttgaccttcattgaaaagcagcggcgcgatgatagcaaaggagaacgccgatggatcaatcgtaaaactacgcagggatggcataattgccaacgctgcaccaaggccaattaagaagaatggcaagggaatctgcgggacatggcgagcaagcaaattgccaacgataaccgtggccaacatgatgccaaaaataacgacttgattcacagcgactcacttcctagcttgaccgattcgatcattttattttagcaccaaactggggaaaacactggttgcaggcttggagagcgtgaaccagcccggtttctggacaggtgaacgcgtttggatcgcctagacggtgcgcaaacggacatactgattaaaaatcggattggtttatttttcagcctgatgtgtcgatagtagcagtgggagcaaaaaaagtgtcgggaatatttcgacacttagtaggataagactattttccttgacgtttttttaacacgtggttcatctttctagctgtgacctgccaggaaagataaagcgccagccagatgaggacgtaaatgatcaaaaaggcgattagaaaatttgggagtgccgatccgacgagaaattgccagcccatgagatagttggtgccgatgacaatggcgaaggtgccgataaaatgaaggctataggctacaggcaggctgagggattcattgtcaaaaataagggcgagcatcccgattaaagcgctcatcacaaacaagccagcgatggtgcgtggcgttggtggggtcagttggacgtgtagcatgagcgcacctagataaacagtcgcaccgatcatcataccgataacgctatccgtgataagatctttgatgattttcatcgggcacctcacaatcctaacaagcgttttaacgcaggaagatatttacgactgacagttaacttcattttattcgccatgaaggctgtcatgttcccggaaaaagacgcttctagtgacgttaaataattaatattcaaaagactgcttttcgttacttggataaatgcttgcgggtcaagtttggccaagaccgttttgagttgaccgcggctttgataaatatcttgatgggtatggacagaaagctgatcgccgtatacttcaacagccacgatctcgttggttggcaaaacaacaacgcgttcgccaacgagtagcggtaaggtcgcgtggctgtcggcgagttgctgaatttgttgcagtaactgcaaaacagctggtgacaatcgtgcagccttgacgtgaacttgcacgtcgtctggctgcatcgttgcgtcttgctcaaacgaaactttcattgacacccctcccgtaaaaagtgcatgcatgatagtgaaacgaatcatggcggtgttgcgataatattggaaaaagcaaccatgataatcaaattaattatacgcggacaagcgctgtttttcgactgactttggctatcagaatgatgaccagtccgacaagcagcgtgaagctagttagaatcaggtaagtttggcttgatgaaagcaggccatgcagatcaattcggatgccgagcattttttcaaaggtctgacgcgccgttgtctggtgaacggaaaaagtggactctaggggttgctgtaggagtaactgccggtatattgcggcattgtagggaaaaggcgtcaatttcatcaaattttgcgcggcagttggaacagaaccaatgggaagatagacgccagcaaagaaaccagctgcggttccaatgatcgtcgaaatgccgctcattgtggtgacccgggacacgaaactaagaatcaaaaggttgaaagccgtccagactaagctgctaaacacggcaaggacgataatctggccggtcaattgccagggaatggcgatgtggtctaaccataaaaaagcaccagacatagcaaagaacataagtaactgcatgatggtgccaatgatcacggcgctaatcagatagcccaactcgatacgtaaatacgaagcttgagttaataaataatcgctaagtcggccagtttcgcgatcaacaatcatccgcgcgagaccattttgtgtggtcgtgacagcggtgatggttaaggtgccgccaattaaccacggatccagcaatttttcgggatgtgccagtggccaaagcgtgctcatacttttcttgagaaagactaaatacagtaaaaaggcaattaaagcgcccagtaccgagaagaagaccccggcgcggttgcgaaagaatagtaacaaattgcgtttgacaaatgcccacatgttaacgaatctcctttccggttaaagcaacaaaaatggtattcatatcagccgcacgaaactcaaagtcaatgagctgcggttgtatagttgtcagtaatgtgatggctgcttggggatggctaacctgcacccgcactgtgtcaccatcgatctgggcggggagattcgcttgggttgcggctatttgtacttgttgaggtgcatgcgtgcgaacaataagctgatgtccggcatactgttgttttagttggccaacagtgttcgcggcgataatcgtgccctgatcaatgacatagacaaaatctgcttgttcggtttcttctaagtaatgtgtcgtcaaaatcacggttaactgtgattgcgcacgtaaggaagcgatggcggtccaaatggtttggcgggtttgaatgtcgaggcctgttgttggttcatctaaaaaaaggagatgaggatgattgagcaaggcgcgcgcaatatcaacacgccggcgctgaccaccagacaatgtgccgtaagcttggctaagaattggcgtcaaatcaaattggtcgaccaagtaatcaaaccaggccggatcagttttggtatacatttgggaacggattttcaagttctcttttacagtcagctgccgatctaaacgactgtcttggaagacaacaccgatttgttgccgataagccgcttgattcggcgtggctgtgcccattgtgatcttgccgctgctgggttgaattaatcccgtcagcatgccgatggttgtcgacttgcctgcaccattaggccctaaaaaggcaactaattgaccggctggaattgttaggttgatatcattgacggcggttttggtaccgtatgtttttgtcagattcgttgtttcgagaaggatcatatctatcaccacttttgtttgatgattcaagcatagccagtgcgagcgaatccgtcccgctgatgccgataagtggtcaaaattgcaaggtgagtggtcagatgccgagggcgaatgacagcggatatttaactttgtggacaaaaggaaagtgaacgtaactgcaattcgtcatgacaagaatttgaaataagttcaattaatgggcaccaaaaaaaacgatgccagtccgaaaacactagcatcgttttaaacattgtccagttgtttgaagtaaaaacagcacagcggctaactcgaaattcgcgtcaggtaaacagaaatgccaaaattcttgcatcaacgtaaggattctggtgcagactgctgtgataggcaccaagcggcgttccgtgatagatgtaaagcgtacttggaatatttgccgcgcgcaaggccttttcaaagcgcttgacgccagcgatgctcacggcccagtcgccacttgcaccaaagatttgaccgccgatgacgagggtttggactgatttagggaattgctgtaattgaggtgtggggtcacggtaaaactcgcttgccaatgaaacgtacttcactacatgcggctgcgcatcagtgtggtgggtcgtgaggtatctaaaactgaggttgctgcccatagaatgaccgacaagattgatcttggtgacgttgtgtttggcacgtagccaatgtaacaaggcagtcagttgtcgggtttccttttccggggctttggcgtcttcaaaaaccacattaactaacggattcttgccggtataccggttagcgccagttatcgtgcggctgccggtcgcgctgatggtaatggtcgtcacttgattggaggcgcggtcttgcttgaagcgggtcaccatcgggccaaaagtcaggccattactggcatagccggggacaaatacggtaacgatggatgtttgccggtaagtctgggcatgaatgcggcgactgcctagctgccaccaaacccaataactccctgccaacagtagaaagagtatcaaaagtaagcgccatccccagcggtgctgacgtgattgtttgcgtgtcatgttgcgacttaccccttttaacaacggtatttagtcaaccaccggtgatagcaggcacggccagtaccgatttagttggcagttttggtaaatacgctgcgcaaaaccggacgctgataacgcgcttgaatatggcgatgattatctgcaaaaagctgctgataacggtgtaattgctgcgtgccaatggtaaccgccgtttgatcgatgacataccaagcaacaccttctgtcagcggcggcgtggttaaggagccaagatagcgatataccgtcccttgttgcggaatgagctgatctaggctgaaggcaacggatcgggttgaatgggcggcaaaatgatccagtatttgctcaagcacaacattgtcaggacccaacggcaagagaaccgcaacgacgcataaggcaccgattgctgactgatggacgaaatgcagttcggcagcgtgttgattggtgatttggtgttcggcaggtacatgaatatgggcctgcatcaattgccactgatcctgatcaattcgggtgcgaccggttccggtaagccggatcgtaacctggtcatcgatttcttgtgtcactcgccacgacgtttcaattttcaacgttgacgggtcagctggagttgccggtaaaagattgatgggtgattgaagttggccaaaaccattcggccatttttcctgatggtgataatctaaaactgccatgttcattgattcctctcatcactagggaataacgttcttgttgattttaaaagccagattcaaccgcggctgaatctggcttttgtgtaagcgcgagccgacgcgttatggtgaaccagctagtcgagtagtttaactgccgtgccgtatgcgacaacgctttgcatatcgccgccgattgatccggagtcaaatcgcatcatcaccaccgcgtcgccacctgctttgcgagcttcagtacgcaagcggtcaattgccttttcgcgcgattcatgcagcatatcgctataggccttgatttcaccgccaacaaggttcttcaagccagcaccgatgttactaatcacatttttggactgagtggttaagccaaaaacttcgccaatgatttcgtaatgtttcccgggaatgttctcggtggtggtaatcaaaatttcctgagccatcatgggcctccttatgagttgcttgatcgttacttatgtacagcggaccatgtatcacagtctcaccgtgttttagcctaccaccggtgtttgccgacaacaagcgaaacgactttaacaacggacggctgcggttggttattgaccaagctgattggcgcgaacaagcaggccccattaacatggctgcttgctattggtcaggctgacttgatgaaacaagttggtggtttattgacgttgttttgtttgcaggtaggtacgatagacggctaaagcggcattatccggtgaatcaggaaacattttttcgggcgcaagcgatgctggcacccatttggcttcggaaatttcaggtgaagtgactaaagactgcttggaagtatgactgataaagccatgcatgagactgccagttttcctgtaccaatatgtgccagcgtagtcgagttgatccagatggatgccgagttcttctataacttcgcgcttggcactctcctcagcgctttcacccggctgcatataacctgagatgatagagacatatttttcagacaaataaggcattttcaccaatgcaatctcatcaaattcattgacgaccagtacgaggacgcaatcggcaaataatggaaaccaaaagcgttggcaagtttcacagtaaggcacattcccatcatcgcctgccaattttggggtgagcgcgtggccacagataggacagaatttaaaagtcatgaggggctccttggggttgagattctgtaattgaactcgctttcataacgaaattaatgatattataaatcttaataatgcctagttgctgcaagcatggttttaaactgaaacatgaagcaggaggcatacggttcaaaattaacgtcatacaggaggaggagttcaaaatatccaatgcaaagatattactagttgaagacaatcgagaatttagtgaattgctgaaactgtatttacaaggcgaaggatacattttaactagagtgtttgatggcaaaattgctatggatacgattaagaataacacttttgatgttgtcttgttagatataatgcttcctgaaaaaaatggttttaatgtgttgaaggaattgcgccagaccaagatgacaccggtgattatcataactgccagagatatggaccaggatgaggttttgggattgagcctgggagccgatgactatctgaaaaagccattttcactggtggcattaaacgcccgtataaaggctcaaatacgacgaacgactcaatacgcggtatacggttatgaaaaaatgcatacccagtcacaagttacatttgctgatttacgattagataatctcaatcaaacagtatataaaaatgatcggcggctcaatttaactgtcaaggaatatagacttctaaagcttttaatgattcaccctggtcatgttttttcaaagcaagcaatttatgagaaagtgtggggggaatcctatattggcgatgaaaacacagttaatgtctgcattaagagattacgcgacaaaattcaagacgttaaccagcgctacattagaacagtttggggaatcggctatgtcctagaggcgggggtagaataatgttgcttatgttgactatcgtgctagctgcctttcttgttatttctttagcctatatcatttcgttaaaaacgaacttgaaacgagcaggtcaagaaatttggcgcttatcggaacaagagttttcgatgccactattacaacaaactaatgtcaaagaattacaacaactctatgcgagtatcaatcatctattaaagcttaatcgagataatcgcctcgcatatgaaagcgcttatcaaaagatgacacagacaatagctaacataactcatgatttgaaaacgcccttagccacagccttaggatatttagaaataatggtggcaaatggatgtcagtctgatagcgtggtaaaggtcagagcaaagagtttggaggtccagcaccttataaaccagttttcacagttgatacgaatagaagctggagatcggcgtaaacaagtgcggttagtcaatattaatgagctctgtcgagaagcgttgttttcaatcctagctcaactaaaggataataagttcgaagttgttgccaacatacctgaataccccatctggattaatagtgacgatgatgctattcgtcggagtttaaataatttgttacaaaatgtttgtgttcacggtgaagatggtcattatttagaattaatcttggccgaaagacttggggaaatccttataaaagttcgtgaccatggtaaaggtattcaaaagcacgatcttgatgcaatttttgagagaacctttatggctgatgagactcgttataagagtggtaaaggtggggggctgggtttggctatcacaaaagctttaatagctcaaattcaaggttgtatttacgttgaaagccaaccacatatttgcaccacgtttaccatcgtgctacctaagaatgcaaagtaaggagtttgtaagattttcgacagggaagtgttagaaatacccattagactataacttgtcaacagaccaatttctaaaaaggatgggaagctatggactactgcattcaaactcagggattaagtaagcattttaaaggggtaacagctttaaagtctgtaaatatgaatgttaaactcggcgagatatatgggtttcttgggccaaacggggctggtaaaagtacggtttttaagctgttgatggctttgctgaagccagacgctgggaaaattatgcgtcaagccgaaactctgtctcaggggttaaatggcttttttagacaaacgggttcaattatagagaatccttatttctatgaagacttaagcgggtatgagaatcttaagatccatgctcgctacatgggttattatgtggagaatgatgcgcagacaaagataaaagacattttaagactagttcacctgtctgataccgaaaagaagccagttagagcttattccttaggtatgaagcaacgcttagcgatggctagagcattgttatgcgatccaaaacttttaattctggacgagcccttcaacggtttggatccagagggattagcaaagatgaggcaacttcttctggatttgaatcaaaggcaacgtacaactatcatcatttctagtcacttattaagtgaaatatccgcaattgctgatacgattggtgttttgaaacagggcgttttaattcaggaaatagctatggaaaaagtcaggcagaaggaacgtcagtgcattgaaattaaagtaagtaatcctaatagggcctcctgcgtgctggaagaaaaactgaatattcatgaattcgatttggtctcaaaccacaaaattctaatttatgataccgaaattgatcgtgctttattaatcaagactttggtaatgaatgatgtcggaattaaaagtgcatttcttaaagagggctcgttggaagattactttttaaagttgacgcgatagttattattaaagtgagggctaccatggaaatgattaagctagaatttgtgaagtttcgcttacaacgacaaataattggtgttgcattaacgattataggcttgcttctctttttgacaatttcctttgtagataataaagtgcatacaaatcaggttttagacactagccaaagtgttcaacgaatgattgcttttttggctgctagtatgtttatggtgtatgcagcaggtttgatatctaaactaattatcggtgaatataaccatcgaacgattctcatgctattctcttatccaatcaatcgaaaaaagattattggagtcaaaatgggtctaattactgtatttacattgatcagtacgtttactacatgtctattagcgcacttttacgtttattgtattgatcatcaattcatggttaccgcaaatacttttacgcttacttctgacgttttgatggggtatttttactgtagccttttagcagcaatgattgctctttgcccattcattcttggcatgataaagaaatcaataattgcaaccatggcgacagctgttcttggtataattgctattcagactatggtgccaaaagtgcttgtttggaaccgcgattttcttaggctcgctatactaggacttgcattagcatctttgtcttacatcatcgttcaaacgaagattctggattttgataagtagtttttggattgacggaagcacagggaagctgttacataattcgggagcttaaacaaaagtatccaaatattaagacggcagaccataatttcaaaccatggggaaccatgatttgtcagattctgaacgataaaaagaatggacggaaattccgtgctgtgtcaagatccgcaattttcagatttaactttcctttgattgctctgccttggcgcaagctatttcaattttgatgttttcgcttacaccttcgaattatgaaccaaccttacctaagtagtcgtgcagtgtacttgagtggatagtaaagtttgatgttaattagttactcgaatgacaatccgaccctcgtggtgactgtcatccagcaactggtgccctttgacaaaaccttcgcgggtaaatggcaacacgtagccgacctgaacgttgagcttgttttgtgccatcagatctatgagcagttgcaaagctttgcctacctcggatccgccaagtggccgggtatgaataaaacgaatgtcccggctgagtaaaggttctgtgtggctaacggaaacgatcagtccgttgtctttggtcatagcgacatcatcatcaccaccaagcccgttcatagcagcgttaatcacgacatcggcagtctggcgcagttgggtgacgggattaccctgatcgtaagcgacaaagtgttcaacgccaagccgctcaaccgcgacttcatgacggctgctggcaatgccgatgaccgaggccccgtgcgcaacggcgagttgaattgctgccgagcccaccccgccagaggcacctttaacaataacagtatcaccagctttaacattgcccagttccaccatgcggtaaccggtgacaccaggggtaatgaccgctacgcctttttccggagtaatcgaagctggtaacaagacgctcatgtcagctgcggcagtgacgatttctgcataggcactggttgttcgcgccaccacgcgatcgcccactttaaactgagaaacattgctcccgagcgcagtgacgttaccggcaacatcgtatcccggtactgtcaagccactgccgcctagttgccgcgccatgcgatcacggttattgagaccgattgcgctagtcttaatttgaatttcatgaggtcccggttgtggtgtcggcaagtcaattgcatcaatcacttccggtccgcctgcatgactaaacccgtatccgatcatcatgattcctcccatcatgccatgttaaactagcggcattgtaaccatgatgcgaggaaaaaaacaattaaagtgacttggtgtgctaaatatcacccgttaccttcaaatcaaatcgccatcagtggctgatacgttattcagcggtcactgatcattttgatgtggtcggggatcgaagccgtgtagctggcctttgaactcatccggaaacgagctgaccggcgtatgctgttcccagctggctgcaacttcttcgtcaaccggttcggcatgctcactgtagtccagccccattttttcagcggctggtgatacgcggatggcaacaaactgggtaaggatactcgtaataatcgtgaccatggcagcgaccaaagcaatcacgatgatggtaccggctagctgaatcagcagcagatgccagccgccgccatatgcgagtccggcgtgggcaatgcttggggccactgttttgctggcaaagaccccggtcaggacactaccgacaatcccggaaacaccatgacagccaaaagcgtctaacgtgtcatcaataccgagtcgtggcttgattttgctgatgaaccagtaactggctaacgttgatgccacaccgatgcaaaccgcaccaaaactggtcacgtagccggttgccggcgtgattccgaccagtccgcataaagcgccggtacaagtgcctattaaggttggatggcctgtttgccaaatatcaaggatcatccaggtgactaaggctgctgcggcgccaaccgatgtggtcaaagccgccgtcattgccgcctgattgacccccagcgccgacccggcattaaagccataccaaccgatccaaagaatggctgttcctagcaacacccacggccgattgtaaggcaccgtatgctcatccgcgcgccggccaagaaaggcagacaaggtcagtgccgtaatcccggcgttaatatgaatgacggtcccaccggcaaaatcaagcacgccaagcccagccaacaagccatccggactccaaattaaatgtacaagcgggtaataaaccaatagggaccacaggacaataaaccaagtcaagaacttaaaatgcatgcggccaaccaccgcaccgacaaacagagccggcgtgatgatagcaaacatcatttgaaagagaatgtaaacgccggttggaatcctagccgccgttgccgtaccaagcgagacgccgctaagaaagagatgctgtacctggccaatcaccccgaaaagattaccattgaagctcaattcataacccacggccacccacagtaaaatcgcaatcccggtaatgtagaagactgacagcatggtattaatgacgttgcgcttagagacgaggcctccatagaaaaaagcaagtcccggggtcataaaccaaaccagaacgcttgcaatgatcacaaatcctgtatcggctaaattcatctgtgccacctcattcatcttgaatggcggtattgtagcacgggttttgccggctacgacgtgagtgccggtttcattgatctagaccaaacgtgttatcgtggtgacaagacttgatttaaaaggatttatggcacggcaaaaaaatattttgaacgtcagcttatataacatgaatgcttgacgatgatttggaatttgatgttttttactgattggtccacatgaaaaacagctagtcatgtcaacattaaaaaagcctcaacaacaaatttgtcgttaaggcagaggctgagcacccaatcgtcatcagcgtttaacctgatggcggtatcgtgctaaattatagttccccgtcagcaattttccccaatacggatttagacgggatgaagaagagttcgcctgttaacggggttgaaaagtccaatagccggtcggatttttcgaacattccttgcaacatccgttttgtgacggtccaatggcgggcatagccgataaagtaggtgccgttgattttttcagccgggttgctgaagggcacgttcatgcggacaattttatgttccacgccgccgtcattatcctgcgaaaccacgttatgtgagttcgccagtttggcttcgtcgtctagttcaagatcgttaaatttcttccggccaatcgctttttcctgatcttcggttgacaggtcgttccatgcgtcgagattatgctgatacttctgggcaaacgcataggagccattttcaaatgccgggtcttcatcgccaatgacggcatattccggcgtgtctaaggcgcttggattctcggtgccatcgacgaaaccgataatggcccgtccttcaaagtagcggaagccgtgggtctcatcgagggttaccgtattggcttcaataatggccataatctcgctcatgagttcgaacggtacggccgagttttgcgagcggatgtggaagaataaatcagccggtgttgcaacggctgtgtatttcggcccaacgatggattgaaaactttctaattcctttggtcgtgcggcttcgggaaaaagatagtcccatgccttgcgcgacaacccgaaagcgactgctaattttgcctcggggtaacgaatattcatgctgttgataaaagctggcagatgctccgccaagtcggcaatcattgccttgtcactagcggggtcttgtcgttttagatcaaacgtggcaaagataatgtctgagcctgcatccttgtaaacatcttgaacgtcccgtaaatcaatggtcatatttctgcctccaaactagaatcattctaacctagaaacagtttagcatagccgtgccggaatgcaatccttttcatcgccggttctgctaatatattagatgaaaaaacgcgatcgttgcatgcgactgttgatggctcacgtgaggtgttagaaggtgttgttatcagtgtggctggaaggcgtcatgagccgtatgtgttttaattgtaagctgtccttttacgtaattttcatcaaatcgacatagctaggtggtaaagtaatcataaaggttgtgatttttaacgatgacaatactgaatcaggttgaattagtcgtccggttgttggtcgcggcgttttgcggttttgccattggttatgaacgcaaaaaccgtttcaaaaacgccggcattcggacacatatgattgtggcgctaggttctgcgttgattatgatcgtatctaaatacggtttctttgatatcttaaatttgaaaaatatggcactggatccatcccgggtggcagcgcaaattgtcagtggggtcagttttctgggtgccggtgcgattttagtgcggcacaataatgtcaatggcttaaccacggctgctggtgtctggacgacggctgcagtggggatggcaatcggcgccaagctttatattatcggcttgtccgcaactgttttggttctgtgtattcaggtgttgctgcatcatcattatcggtggttaccaggtggcgataatggcattttgaccattcgcattcgtaatgaagggttcgatatggaacacatgcgacaaacactgggtaagtatcacattaaggtcctaaacgtttcgattaaacatgaaggtgatgaagtgaagatgacgttgcatgttgaaagtaaagccaatgaggatatgcgacgtttgttgatgttttatgcagataatcccaacattatttcaattgagttttaagctgtttaattgatctgactggttccatcgctgtaattgagggtgacgccaggctggacattgaagatatacacattaaagcgaatcgtgttatcgccaatactttgcgcccgcatggccacaccgcgggctaggcgttcatcgccgcgaaaaaccggggtgacttcatagcggacaaagtgttgaggggattgtttgagataatgcgcaatgtcatcttcatgtgcctgcattaaaggtgagttgagttgacgtgtgcctgtcatcagatttttgggattattattctcgccggataactgaaaaccgatcaaatgactgcggttatagagccattcaccatgaactttcttgttatgccagccagtcggattccaagtcaaaggctcgcgttttactttgggcatgatgctttggtttaaaagggcattcgcggtaccgacgcggtttaaagaatccaagtcgctaaaacgcgtccatggtccgttgctggtagtcagctcggattgcgtaaaaccgggatcattattgttgattgtgatttctggctgaccgttttcggtaagttgtgctaattgcttaaccggttgctgtgacgtgccggttttggcggttgatgtgctactactgctactactagttaaagctggcagccaattggtttgcgggtgttgttgcgtataagtgtaaccgccactcgcaatgccaactagcaaaagagtgattgcaagtttacggttggcgcggcgttggcgtttagtgccattgcgtaataacagcagcgttatgccagcaaggatcagcatcaatgtgactaagttgttcataggttcctccagatggcgattgtcgtggaaaagatatggtttgaggttaacacaagtctgactttgcggggcagggtgtttttcggtggatttggtaatttgttcattcgattattagattacgcaaaagaaaaggtaaaaagcgggtgacaccgtgtcaccgcttgaattcttaggttgtagatgttctggttcacactttaaaggtgtttataattgcaggtacctgcgtgtaaggaccttaagtgcgatggccaaagctctggtcgtcacgtctgaggccacttatgttctagtttatgctcataacgcgctcaccggcgcagggatctgcgtgtaaggaccttggtcgcaatggccaaaaaccggccatcacgtccaaggccgcttatgttctggtttatgcccataacgcgctcaccggcgcagggacctgcatgtaaggaccttggtcgcaatggccaaaaaccggccatcacgcccaaggccgcttacactccggtccctaagcgcgccggttcgcgctcacgctacatttgtgaattccctcaatatctgctaatatatgtagaaatcttttaagcgaggtatgaaattgctcacagtaaataatgtttcgatgacgttctcggatcggaaactttacgaagacgttaatttgaaatttacccctggcaattgctatggcattattggtgccaatggggcggggaaatcgacttttctcaagattcttgaaggcgaattaacaccgacaaccgggaccgtgagtttgtcaccgaatgagcggatgagtagcctgaagcaggatcactttgcctttgatgatcaaacggtgatgaatacggttttgcaagggtgggaacgcttgtatcaagtgatgaccgaaaaagatgccttgtatgccaagccggacttttctgaagcggatggtaataaggcagccgaactggaaggcgagtttgcggaaatggacggttggaatgccgaaagtgatgcctcgcagcttttgcagtcgttggggattagcgaaagtgaacaccagaagctcatggctgatttgcctgaaggtgagaaggtcaaagttttgctcgcccaagcgcttttcggtaagccggatgtgttgttgctggatgaaccgacaaacgggcttgatccgcaggcgattagttggctggaagactttttggctgactatgaacacaccgttttagtggtttcccatgaccggcatttcctgaatgcggtttgtaccatgatgtgtgatgttgattttggcaagattgaattgtatgtcggtaattatgacttctggaagcagagctcggaattggccttgcaactgcaaagtcaggccaatgccaaaaaagaagagcagattaaacagctgcaagaattcgttgcccgtttttcagcgaatgcgtctaaatccaagcaagccacatcgcgcaagaagcaacttgaaaaaattacattggacgatatccgtcccagttcgcgtaagtatccgtatatcaagtttgaacctgaacgcgccatcggtaacgacttattacgggtcgaaaatgtttccaaaacgattgatggccagccggtgttgcaaaatgtgagcttcattttgcgccccggtgacaaaaccggcattattagccgcaatgacgtgacggctaccgttttaatgcagttgctggctggcgaactggagccggatagcggaacgattatctggggtgtgacgaccagtcgagcctcgatgcctaaagacctgaatccggagtttgaccatccggaacttaatattttggattggttgcgtcagtttgccccgcaagaagaacaggacaacactttcctgcgcggttttctgggacggatgcttttctctggcgacgaggtactcaagcagcttaacgttttatctggcggcgaaaaggtacgctcatacctggccaaaatgatgttgagcaaggccaatgtgctcattatggacgatcccacgaatcatcttgatttggaaagtattacgagtctgaatgacgcgttgattgatttcactggctccttgatctttaccagtcacgatcatcaatttattcaaacgatcgctgaccatattattgaagtcgggccgctgggtgtagtcgaccgcgccgacacaagttacgacgaattcatgcaacacgaaactgcccaggcacaggtggcggcgatttatccggcatctgagcattaagcgaaattgttaatgaaaagcattgttgctcccgggtggagagacaatgctttttgttttttctgcaacggtgagggataatgtaagcaactttatccggtaaacgtctggtatcgctgcatcaaagggcaaaaggaaggaattcaacatgacacaaccagtcatgattttattaggtgttgggggtttcgttgttgcaattgtgctgctcaaccttatcttaacggggcaacgacaactgaggcttaaacgcgatctgattgcgaattggggcaagctgccggttaaacgtggtggcagtgagcgctatttaaaagcggcgtaccttgatcatgaagcgcaggttaaccatgattgtcagattgatgatttgacctggcaggatctcgatatgtttgacgtgtttaaacaattgaatgcgactcagagcagtgtcggtgccgagcgggtttatgcacaattgcgggcctatgatttaggcaaacccgatgtcaatgaaacgttgatcagctttttccagacccatgcagaagaacggctcaaagtgcagctggcatttgccggactgggagaagatgttgctaacaacagccagcattatttacgcaccacgactcagtccgctttgccgcatgcttggcggtttaaagtgttaggcagtttgccgctggtcggcttggtgctggcgctggtacttccggctattggggtgagcatcagcgtcttgagcttgatggtgaatcttttctattatgttttaaaacgtgaagccttggatgctgaagtaacggcgatgggctacttggtgcgaacgattgttaccgcggaacatttggttaaaattcagcagcccactcaggatgctttacgcgctgccgttcgaccgatgcgggggattagattacccggttggcgtttgtgtttcgctcgcgagataacagctcaagcgacatgatcaccgagtattttagcagcatgtttatgttgggctttattgcttataataatgtgttgacgcgcttatatcaccaccatgacgaggcattgactttgtggcaggcgttgggcgatttagagttagcgattgcgattgccaattttcggacggctcattcgcaaagcagccagccggcgtttgctgcaggcggcatgacggccacgggaatcatgcatccgctattgaaacacccagttgccaatccggtagcgtggaacaaaaatgccttgattaccggagccaacgcgtcagggaaatcgacatacgttaaaagcatagcggtgaatgccattttggcgcagacgattaatacggttttagctgaaaagttgacgatgcagccgggattggtgatgacagccatggcggttcgggatgatctcagtgaaggcgatagttattttgtcgcggaaattaaagcgattcaccggttgttaagggccgtggcgtcaaacaagcgggtatatgggtttattgacgagatcctaaaaggcaccaatacagtcgaacggattgcggcctcggccagtgtcatcaactggttaagccattatccaagtttggtcgtggtagccacgcacgacaatgaactaaccgacattatgggggatcagtgcatcaattggcattttcaggaaaaagtgacccaaaaagatggcgtcgtatttgattacttactgcatcaaggaccggccacttcccataatgcgattgcgttgttggcaacaatggcctatccggagccgctgattaaagatgcgcgtcaactcgccgcagatttcgaacgcaacaaagcatggcccaaatatcggcaaggagggattcaagcgtgacaacggccgacaagatttttgaagcaattcggcaggatccggctaatgcaacctttacggctcaaggttgggatccgttatatcacatcgaacctgacgcaacgattttgatcgcaagccaggcgccgggacgcaaagcccagacaaccaaaacctattggaatgatccaagtggtgatcgtctgcggacatggatgggcgttaccaaagatcagttttatcacagcggtaaaattgctgttttaccgttagacttttactacccgggaaaaggcaagtccggagatttgccgccgcgtaaagatttcgccgcaaaatggcatccgtccttgttagcattaatgcctcatattcagttgaccattgttattggcgcatacgctcagaaatattacttaggcaagcgccgggaaaagacgttaacggcaacggttaaaaactttcgcgcatacttaccgacgtattttccgattgtccatccctcgccacttaactatggttgggtcaatcgcaatccatggtttatggatgaagttgtgcctgctttacaggagcgagtggcacgactgatgaagtagggttcaactataacgtgttaaccgcgtgggttcgcgctcacaccataacgcgctcacagtcgcagcaatctctgtgtaagaacctctagcctaaatggccaaaaaccagccatttaggctagaggccacttacactccgattgctaagcgctcctgttcgcgctcaccaaaaaaccgccattcgtacttatcgacgaattggcggttttcttacgttgtgagtttctaaggataggttacggcaaaaccgtgaagatcaaagcaccaacgacgccgcctgccaagggtcctaatatcggtacccaagcataaggccagtcggaatcgcctttgtgtgcgattggcaaaatggcgtgggcgaggcgtggtcccaagtctcgtgccgggttaatggcataacccgtcgtcccgccaagcgataggccgatagcggtgattaagatgccgacgccgattggattcagtccgtctgtccattttcccttagtaaaggccaaaagtccaaagatcaagacagccgtgccgatgaattcggatatgaagttggccgcatagctgcgaatcgcggggccagttgcaaaaacgcctaacgttgtcgcaggatcgttggtcgcttcccagtgcggatagtaatgcaaccacacaactgccgctcccagtaaagcaccgagcatttgcgcaccgacaaatggcatgacccaagcccatggaaattgaccgatggcagcaaacgcaagcgtcacggccgggttaaggtgggctggaccgagaaatgccgcggcataaacgcccatcgtcacggctaagccccacccgagtgtgatggcaatccagccggcaccattcgctttggatttattcagcgatacgccggcaacgacaccatcgccaagcagtaccaggatgaaggtaccgatgaattcacctaatgtttgtgtccacatatggctacctctttctacgcaggattggttgatgctggcgtcttcttcaaatctgctaattggctttcacgaatggcctgattaagatctgccaattgttgggctttagtcgcgtcatcccaacccaataagcgtgccatttcatcaacgactggctgtttaagctcattaagggtctcggcatggaagagaattgcattggtccgccgcaataggtaatccactggtgtcaaggtcatttcctcgttgatcgaatagcgcaggctcatggtttccttaaggctgagtccaggagccgcctgcccatctgtgtaggtgacaacccggctgacatttgaaccgaagcgattggccaagtcggcggcatctttttccggcaagccggcatcgatgccaatccgcgtgtaaaaagcaatcgtatcgtcaacgttggtcgggtcaaaatgaccgcctgaaacctggagctttttggaatcaacggtccgtgtttcggttgcaaaatgctcagccaacaagcggcggatcaaagcaagcgcgcccgctgccatttttcgataatccgtgattttcccaccggacaaggtgatcatgccatcatcggcttggcgaagtgagctgccgcgggaaacctgtgatgggctcaaagcagcttcggcgtgggctgtttctagtttggagatcgcatgttcaacgtcagcgcgggtagcctggttgtcttcgtaatcatcaacgacacggattaacgcttcaaaggaatcatccgaaactttaccggtgttggcaccgccgccgttgtaatcggagctgccgttgttggcaatcagcggtcgcaatcctgcccagctcgcttcgatgtcgtctagcgtgatatggctttgcggatagcgcttgttgatgactttcaagagataatcgacatcggcttgttcgacttgcggatggttgaagtcgccatggtaatcggtatcggtggtgccgaagtaagtcttgccttcccgtgggaccacgaagaacatccggccgtcgttcaagccagtatccatatacgttggctgtggtaccggcagtcgagaaccatcgacaaccaagtgaacccctttcgttggccgcaatgttggggtttgatcttcggcttgatccaacgccttgaacttgtcagaccaaggtccggtcgtattgatcacgagtttggcatgaatatcgaaaacactgccatccaaaagatccttaacctgtaagccattaacctgaccgccatcatcatgcaaaacgccaatggcttgaacccgactggccatcagtccgcctaattctgccgcttctttgatgttttcaataacaagccgggcatcgttgttgacaaagtcgaggtacacgccgccgccttggaggccatcagcggctaaatgcggttcacgctgcagaatttcatctttggtgacggtgtagttggcgtattgggaaccttcaacgtttgccagacgatcatagagatccatggcgattttgatactgaacatatcaaaagtactgccggcttcctgataaatcggcaacaacatcgggaatggccgcggaatgtgaggcgcaattccttgaactacggcacgttctttaacggtatcggcgacaacgccgacatcaaacgtcttgaggtaacgaatgccgccatgaaccaatttggtcgagcgggaactagttccttccgcgaaatcctgcatttcaatcaagccggttttcaaaccgcttgcggctgcttgaatcgcaacgccggcaccggtgataccaccgccaacaatgagtaagtcgagttcggtctgcttcaattgatcaatcgtctgggtgcgggtttcttttgaaaatgccattttgagtaggctcctttttaaataagataaatgatggcgcaataagatcgtgctttagaatgaattagtcttgcttggtggtgtgtttgtactgctgggtggcggcaacggcttgtttccagccttcgtaaagtgattcccgatccgaaacgtccatggtcggttcaaagcgcttaccgaccttgacgatgctctggagttcatctgtgctgttccagaatccggttgctagcccggcaaagaaggcggcacccatggcagtggtctcaaggttggcggcgcgttcaatcggaataccaaggatgtcagcctgaaactgcatgaggtaatcgttattagcagccccgccatcaacgcgcagagctggaatcggcatgccggtatccttgttcatcgtgtcgacaacatcacgggattgataagcaagcgattgtaacgttgccttgatgaagtcttccctagttgttccacgggtaattccgaaaatagcgccacgtgcgtccgaatcccagtaaggagcacctaaaccagtaaaggcagggacgacatagacctcgttttgactcttggatgctagtgcggcagcttcggagtcgcttgaacgttcaatcagtttcatggcatcacgtaaccattgaatggcgctgccagccacaaagaccgaaccttccaaggcataagtgatcttaccgttgagtccgtagccaatggtggttagcagattatgattcgacaaggttggcttatcgccggtattcatgacgataaaggcaccggtgccatacgtgtttttgaccattcccggttcgatagccagctgtccgaataatgctgcttgctgatccccgaccataccggcaatgggaacggtactgccgaagaaatgataggctgctgcatccccataaatttctgaattgctgcgaacttccggcagcatttgcttggggatgttgagaatccgtaagatctcatcatcccaatccaacttgtggatattgaagagcatggttcgtgaagcattggtgtagtcggtgacatgaatggcaccgccagaaagcttccatgatagccaagtgtcaatggtgccaaaaagcagttcaccattttcggcccgttcctgcgcccctggtacatgatccagaatccagcgaattttggtagcagagaagtaggaatcaattagcaaaccggtggcatcgtgaaccagatcagcatagccatccgctttaagttgatctgcaatgtcgctggtttgacgggattgccagacaatggcgttgtaaatgggcagcccggtttgcttatcccacacgaccgttgtttcccgctgattcgtaatgccgatcccaacaatttggcgtggttgaatatgcgattcgataaacgctgtggcaatcgtggataacgcagcattccagatttcatttgcgttatgttcaacccaaccaggatgtggaaaatactgtggaaattcgcgctgggcatcagcaactttttgcccattgtgatcgatgatgatggtacgcgtgctggttgttccttcatcaatcgccagaatatactgctgttcgtttgtcacggttaactacctccagtaaaatatgattgcgcacaatgaaaacgttttctaaaatagttatacatgactttgctgctgattgcaagtagtacacttatatagataataagttattttaactataaggcgaatatttaaaagtgcgaatatatagaactagcccaaacccgcgggattacaggctcaaaaccagtttctcacctcaactagtccggctgaattaatttttttaattcaagaatacgttcaaatattcgagtttcctggcgccgatcagccggggaaaatcggtgcatcgtgctgtcgggacggttgactttggtgtagagaatggttgggttgtaggcatacatgccgggcgtatgggcaacgaagtcagcagtaaagtagtaatcttccgcaatttgtaatcgttcatcatatcgaatatgcccggcatttaagctggcacgagggaaagccttattccaaatataaccgccaatttcggtaccgtgatgcgagacctgttcaaacattgccgcttgtgatagcaattgaaattgatcggggccgccgcggttacgctgccaccagtcatagccgacagctgttgcgacaacgccgggggtaaatccgcgcagcaaggtcgcagcaaaagccggtgcaatcagatcatcaccatcgacaaacgcaagaaatagcccagtcgcatggtcaatgccaaaattgcgtgcggcgccgataccttggtgatgggaaaagacggttgcgtgataattggggatgccatttacaaacgcggcggcggtttcggcagtttcatcggttgaagcatcatcaattaaccaaagttccacatcgatggtttgttgctggatgctctttaaagtcgctggaagataccggcctaagttataggtggggacaataatggttaaatcaggaattgccatgatgacctccttgaaaaagatgtgccgttacgttcaatattttgtccggattgttaacagcttgctcattcgtctcgatcattatcgtctgatttaggaaggcgtcaattaaaatgcttggcgcctatcgctttattcttatatgaggacatgtatgttcatgttagaatagcttaaatcaggcgctttaaacgctttcgacaaaagatataaacatagcaatttctaagtgagagaattaagcctgaattattcaactttcaatcgttaagtacaagatccttgaaatgataaaaatctgacgtgaaatcaggttttccagacttttagaacagcatgctttagaagcgttattttttgcagtattgtccagaggaagattttttaatgactgagataccaaaactggtctgtgaaaaattcaggttaagaacacagcacagatagcaagtggagcctttcatggatcgatcaagtttgttattttaaaattatttattaatgagattttcgctagttataaggaaaataatgaatatcaataggtacttacttgttctaatattatgaaaaggttgacatttatgttattggtctataagataattaaaaatcgatgttaaagatagtgctcttgaaaagactgttgatgatgagacataattttgtcgaaacaaaaaagaaagcatttgcgtgggctggagttttgacgctcgctttttcagtaacaattctgccccttgctgatgttcaagctgctacagattcacagatcaatattgttaaaagaacttcgaatcaacaggtggaaaatggtcttaaccaacggcctgctcaattaatcacagatggtcttcctaatgcaaattatgggtatattaaaggtaataaatggtattttgctcaatacataagtccgagtgatgtcaaaacaatttctgaggcaggtaatctccctgactttttactagtagataatacgactaagtttggcatagacctttttatcaatgacttgataaaaacactgcatctatcaagttactttagtgggtatatgttatatagtgcaatcttcgcggattatttaactccattcaaaaaggctgctcaagaaggtcgaggaatttatattgttacagaggcagatatgaccaacccaactgctggctataactatgttgagtataggatagcgagttactaaccttattttgagtagagttgacaagggcttattactggctaaaagggcaaatactatgaaaagacttagacttataactgttaagagaatattgatatttgccgtcattggcgccattggttgcatagtaacagagctagtaaccaaaatagatcctaatgttgccagttatatttgggtgataggcttctttgtgacctttaaagttgcagataatgtctcaattaaagcaactgcaggtaaaggcagcaaacgttaaagtataattacttgacagggcctgacagatgtaattggaatgacgaacggagagtctccctaactgaatgataaataacggctgtgtcaacatagtcgttattttatttctatgaaaccttgttaggcaagcgtagttaattttaaaaaccattatgaaaagcattgcgagaatcaagtttaaagtaggtcctgaagaagttcaaataaaacgtttacattttgtttatatgtggtacaatttgtttgttgataggaatattcattgtggattgtgactattcaattaggcgagaccacaaatcatgacgctgagagtagcgcgtgatttgtggttttttctatgtctgggtgaggagatgatgagatgccgaaaatcgatcagatctttaacaataacgtggcgttggttgagctagacaaccatagtcaagcggttgttaagggacgggggatcgcgtttagaagcgtggcgatgtgattccggctaaacaaattgaaaaaattttctaccttgcaagtgaaacttcccgccagaatctgtactttttacttcgcaatattccgatcgacgtggtgacgaccacttatgaaattattgacgttgcgcaaaaacaatttcaccttaaggtacttgactatatttacattacgttaagcgatcatatttacgaagcctataaacgttatcagaatggaacgtatcaagagacgatggtgccggattttcatattcagtatcctgcagagtatgccgtagctaaccaagcgttgcagatcattgcagctaaccttggcgtagcatttccaccttccgaagtgaaaaatcttgccttacattttatcaatgccagcggtgaagacgacaacgagcaggcctttgacaagaataatgaggcgtcattaagtcaactggtgcaacgtgttttgaagcggcatcgcattacgagatcgcaaactaacggcaattattatgatcgcttcatgattcacttacagtatctgattgaccgactgcagcgtgttaatacggatgctgttgccattgtgcccgaggtggccaatgaattagagctaaattatccgcggtcttatcagattgcttcggaaatttttgatgagattaaggatcagctttatcgcaacatgagtgaagacgaacgcttatactttatcattcatattcaacggctaattaacgaagcgcctgcccacgatcaaaaacagggcaaaaaatcataacgcgtttgctggcttggagggcagcatacgctcacgggaggaaagtatcatgaataaggttttcgataagctaaagccgatttttgaagcgattgcggcgaataagtatgtgtccgcaatccgtgatggctttattgcctgtatgccgatcatcatcttctccagtatcttcatgatgatcgcttatgttcctaatgcttgggggttttactggcctaagaacgtgaccgataccctgatgattgcttacaactactcaatggggttgttggcattatttgttgccggtacgactgcaaagaatttaaccgacagcaagaatctggaattacccaagacaaatcagatcaatccggttgcggtcattgtcgcttcggaaatcgcctttgtcattttatcgattttgccgcttaaaaccggagtggatttaacctacatgggcacccaaggcttgatctgcgcttatatcgtcggcttaattgtgcctaatatttactacgtttgtattaaaaacaacgtcacgattaagttgccgccacaggttccaggcaatatctcccagtcatttaaagatttaattccaatggggctatctgttagtgctttttggctctttggcgttgggtttaaagcagcaacgggaacgatcctgccgcgctggattattcaagtattgtcaccactcttccaggccagcgattcttatctggggttggcgctgattgccggcgcgatggcgttcttctggttctgtggggttcaggggccttcaattgtccagccggctgttgttccgatcatgattgccaatacggcggccaatctccagcaatatcaagctggacagcatgtttcacatgtgttggcaatgaacacgatggattatgttatgaactttggcggtacgggatcgactctggttgtcgcattcgtgatgctgtttgcggcgcgttcggcacaattaaaagcagtcgggaaagcggcttttatcccgggaacattttctgttaacgagccggtacttttcgggatgccgattattatgaatccgatgtttttcattccgtttttggcaacgccgatcgtgaatgtttgcctgtttaagttctttgtcagtgtgttaggcatgaatagcatgatctacaccatgccgtggacggtaccggcaccaatcgggatcttagtttcaaccggttttgctccactggcatttgtctttgtattgttgacacttgtgttagacgtccttatctacttcccgtttattcgcgtgtacgatcgaacgcttttagccgaagaaaaagctaaagaagatgtgattgaaggacaggatacggcggttttggctgccgatacggttgcaccacaaacggctgaggttcaggtcgaagcatccgaaatggctgatgaaaaaccagcggcagcgcatgatgagagtttcttcaaaaataatgaaattgacgttcttgtgctttgtgccggtggtggaaccagtggcatcttagccaatgcgctaaacaagctgtctaaggagcgggggttgaagttgtccgccgcggctcgggcttatggacaggatatggacttgatcaaagatatgagtatggtcattctggcgccacaaatggaaagtatgaaggataatttgaaaaagattaccgataaatatggcgttaagttggttacaaccactggccgccagtacattgaactgacaaacaacggcgatatggcactggattttgttgagtccaatctttaggtgttcatcaacttagacagactcgtctgcatactttataggaggaagttcaaacatgcgtaaacaattacccaaggactttgtaatcggtggcgcaactgctgcttaccaagttgaaggggcaaccaaagaagacggaaaaggtcgagttctttgggatgattttctggaaaaacaagggcggtttagtcctgaccccgccgctgatttttatcatcgctatgatgaggatttggcgttagcagaagcatatggtcatcaagtaatacggctttcaattgcctggtcgcgaatttttccggatggtgccggggcggtggaacctcgtggcgttgctttctatcatcggctctttgctgcctgtgccaagcatcatcttatcccgtttgtaacgttgcatcattttgatacaccagaacggttacacgcgattggtgactggctgagtcaagaaatgctggaagattttgtcgagtacgcgcggttttgcttcgaggaatttccggaaatcaaacactggattacgatcaatgaaccaacgtccatggcagtgcaacaatatacgagcggcacttttcccccagcggaaaccggtcattttgataaaacatttcaggccgaacataatcaaatcgttgcccatgcgcgtattgttaatttgtacaagtcgatggggctagatggtgaaatcggtatcgtgcatgccttgcagacaccttatccatatagtgattcgtcggaagattagcatgccgctgatttacaggatgcgttggaaaatcggctgtatttagatggcacactggcaggagattacgcccctaagaccttggctttgatcaaagaaattctggcagcaaatcaacaaccgatgtttaagcgtaccgacgaagagatggcggctattaagaaggcggcacaccagcttgattttgttggagttaacaactacttcagcaaatggctgcgcgcttatcacggcaagtcggaaacgattcataatggtgatggctcaaagggatcgtcagttgcccgccttcacggtatcggtgaagagaagaaaccggccgggattgagacaacggattgggactggtccatctatccgcgtggtatgtatgacatgttgatgcggattcatcgagattatccgttagtaccagccatctatgtcaccgaaaacggtattggattgaaagaatccttaccagcagaagtgacgccaaatacggtcatcgcggatcccaaacgcattgattatttgaaaaaatatttaagtgccattgcagatgcgattcaggctggcgcgaatgtaaaaggctactttgtctggtcactgcaggatcagttttcctggacaaatggttatagcaaacggtacggattgtttttcgtcgactttccgacgcaaaaacgttatgtcaagcaaagtgccgaatggttaaaacaagttagccaaacgcatgtgattcccgaataagcgcaccggctcgcgctcacattaacgcgctccccggcgcaggaatctgcgtgtaaggacctcgaacgcactggccaagagcgggccatttcgcccgaggccgcttacactccgatccctacccgcgccggcccgcgctcatattaacgcgctccccggcgcaggaatctgcgtgtaaggacctgggtcgcaatggccaaagagcggccatcacgcccaggccgcttacactccgatccctaagcgcgccggctcgcgctcacttttttaaaatggaggttgaattatggcgacgagagaagagatttcgatggttgggtttgcacttgtggcttatgcaggagatgctcggactgcggctttgcgtgctttgaatgctgcagaagcgggtgactttgaaggagccgaggccaaacttgacgaagcgcaaaaagatattaatgaagcgcataatcaacagacgcaattgttaagccaagaagcaggcggagcggaaatggatgtgacttttatcatggtgcatgggcaagatacgttaatgaccaccatgctgcttattgatcagtctcgttacatgattcgaatgcttaaacgtatcaagcaactcgaagacaagcaataagctaaaacccaacacccgcgctcttcttgtggtaaaactgaccaagtgatagcgtctgatttggtaaacatgttgccatacggattaaacagcaaaagcatcggattattgtaggtgagataatctgatgttttttgtatatagtgacgatgtttctgcattttttactaaaacatcagcaaacaaatcagcggagttttggaagcttatttacgagctgaaaaaatattcgacaatagcgcttccattttggggttaattttagtaaaataaaaacggttacaaaaatcgacaaataattgacgcgtttttaaatattaggaggtattggcagtgaacagtacagatgtcacgaaaggctttacggagcaatttggcaagcaagcagaacacacttttttcgcgcccgggcgaattaatttgattggtgagcacacggattacaatggcgggcacgttttcccttgtgcgatttcgcttgggacgtatgcagcggttggggcaaatgatgacaatgcgttccgtttgtattcggccaatttccctaaagtgggtattattgacattccgttccctgatcttttccaggacaagcgcggtttgtggacggattatttccagggaatggcgcgggtcatgaaaacagcaggtatcaattatacgcatggcttaaatgtttatatcaacggtaacttaccggatggtgccgggctatcaagttctgcttctctggaaatgctggtaggcacgattttgaacaacttattcgatggtagttttgcaccgctggacttggttaagttcggggttaaagtcgaaaatgattatattggcgtcaattccgggatcatggatcagtttgcgatcgaaatgggacgggcaaaccaggcaactttgctggataccaacaccatgaagtatgaatatttgccggtagaaatgggcgacaatgtgattgtcatcatgaataccaacaagcggcgtgaattaaccgattctaaatataacgaacggcgcagcgaatgtgagaaagccttggcgatgttgcaaaaaggcattgatgtcaagagtcttgggcagctaacggaagatgaatttgatgaaaatacttatttgatctacgacgagacattgattaagcgtgcccggcatgcggtatttgaaaatcaacgtacgttaacggctgctaaagcactgcagtcaggagatcttaaaacctttggcaaattagtttctgcgtcaggcgtctccttggcttttgattatgaagtgaccggaattgagttggacaccttggttaccaatgctttgaagcaacgtggtgtgttgggggcgcgcatgactggtgccggttttggcggttgtgctatcgctattgtcaacagtgcagacgttgaggactttattagtaacgttggtaaagcttatactgaaaagatcgggtatgacgctcacttttacgtagcggacattgccgatggtgctaagcaattggattgaggcaaaaaggccaaatgttcggcttaagtaaacgcatcacaaacattcaaaggagcgatttttaatatgacgattgcagttttaggcggcgcggggtacatcggttcacacacagttaagcagttactggcagatggagaagatgtcatcgtcttggataatctgattaccggtcatcgtaaggcggttgatccacgtgcccggttttatcaaggggacattcgcgattaccattttttgagtcaggtttttagccaggaaaagattgacgggattgtgcactttgcggcattttcgattgtaccggagtcgatgaaagatccgctgaagtattttgacaataacacaggtggcatgattaccttgcttgaagccatgaatcagtttggcatcaagaagattgtcttctcatcaaccgctgccacgtacggcgaacctaaacaagtgccgatcaaggaaaccgatccgcaagtgccaactaacccgtatggtgaaagtaagctggccatggaaaagatcatgcattgggctgacattgcttatggtttgaagtttgttgctttgcgttactttaatgtggctggggcaatgccagatgggtccattggtgaagaccatcatccggaaacccacttgattccgattatcttgcaggtggctgcaggtacccgcacaggcttgcagatttacggtgatgattacccaaccaaggatggtaccaatgtgcgcgattatgtgcatgttgttgatttggccgacgcacatgttttggcactgaaatatttgaatgccggcaatccgtcatctgcatttaatattggctctgctcatggcttttcaaacatggaaattctcaatgctgcgcgtaaagttaccggtcaaaagattccggcaacggttggtccgcggcgtgccggtgatcctagcactttggttgccagttcagagaaggctcgcgatattctgggatggaagccaaactacgatgacattgataaaattatcgaaacggcttggaactggcatgaaaatcatccggaaggcttcggtgaccgtaattgacggcaattagcaatcacattgagaccattatcaagctgaatcctgattacacgcagatggattcggtttatttaaccaataagttgcttaatttaatcggtgatgcggcgcttgaactgccaggtgatccggacccgctgaataatctggatttaatggtcaaagccgcgcaaacgaacggtaaaattgcggattcacaggctgcacgccaaatccttgaagcccaattaatggattttgccacgccaacgccaagccggatcaatcagttgttctgggataaatatcaggcaggaccgcgtgcagccacagattggttcttcgcgctaagtcgagcaaacaattatattcaaacgcgggccattgctaaaaatctggtctttcctgcaaaaaccgagtatggcgatcttgaaatcacgatcaacctatccaaaccggaaaaggatcctaaagatattgccgccgctgcccatgcgcaatcgggttatccggcgtgtgcactttgcttgcagacagaagggtatgctggccgaagtaattttgccgcacgtactaaccaccggattatccgtttcttgttaggcggtaaaacctggggctttcaatattcgccttatgcgtattttaatgaacatgcgatctttttggacgctattcacgagcccatggtgattgaccaaagtacttttaccaacttgctcgacattgttgccatgtttccagactattttgttgggtcaaacgcggatctgccaattgtcggcggctcgatgcttgctcatgagcattatcaaggtggacggcacacatttccgatggcgaaagcgccgatcgaaacgcaaattgagatcagtgggcatccgcatgtttttgccggcattgtgaaatggccgatgagtgtgattcggctggtcagtgccgaccgcgaagaattgatcaatgcggctgaacacatccggcaggtttggaatcagtatactgacgaagcggttaatgttcgtgcttttgtggagggtaagccgcatcatacggtgacgccaatcgcccggcgcgtggggtcagagtatcaactggatctggttttgcgggataatcaaacgagcgaacagtatccggatggtattttccacccgcatcaggatgttcaacatattaagaaagaaaacattggcttaattgaagtcatgggtcgggcgattttgccagcgcggcttaagtctgaattagcagaagttaagaagtatctcttaggcgaggctaatgagatgaagccaatgcataagacttgggcagatcagctgaaagtggcttacaattggacaccggaaaatgcggaaagtcagttgcaagaagcagtcggaaaagtcttcgcccgggtattggaagatgccggcgtctttaaacgtgacaagatcgggcaagaggcatttggccgcttctgtcgctcgctatagttgctggttattgttaatggtcagggaaacggagggaatcgatgaccacgattacggatattgcgaaggcggcgggggtgtcgatcgctacagtttcgcggattttgaattatgacgctacactggcagtaacgccggaaacacgccaacgggttctaaaaacagccgagaagttagcgtataaaccccgtcgccgcaaacgcgttgctactcaaacaacggtggctctgattcagtggcggagtgaacaagaggagcttaatgacctctattatctgcagattcagtacgctattgaagccagggccgcatccattggttatcatgtgcaaaatctgcacctggagcaattaaacgcggaaagtgttgcaaatgttcagggtatcattgcacttggcaagtacgatgcaggtgaggttgccgaaattaaggcgttagggttgccgattgtgtttgttgatcagaatatgctggcgtttgattgcgattccgttaccggcgattatgctggcccaattgcccagatcattgatcattttcagaaggtcggcattgatgatattggttttcttggcggattggaaacgagccgcagtggacgcgaacagtttcaggatgttcggaccgcgacatttgatcgtgtgactaaagctgccggaatcgatcatgccgagtttcgattgatcggtgaatttaccccggattccggttatcggttaatgcgacaggccatcgaaaaactaggtgagcggttgccacacgcatttatcattgctaatgacaccatggcggtgggtgctttgcgggcgcttaatgaagctaacatttcggtaccgcagcgtgtttcggtcatcagttttaatgatgttgccgtggctaagtttacaacgcccccgttatcgactgtgcatgcagcgaccgatcagatgggtcaaactgcagttgagttgctacaggcgcgcttgaatgatgctaaacgggttccacgacaggttaatttcaaaagcgagttgattatgcgcgccagcagtttgtaggtggcaccagctgtcagatgataccgcaagatggctgtacacaatccgggaaccatgacataaggaggttatgatggacgtttcagttgagcaatatggtcagtatcagggacaaaatctttatgaattaaccctcaccaacgaccaaggtatggtagtaaagctgttaaattatggtgcaacgttggagaaggtgcttttaccggaagcagatggtctccacaacatggtgctgtcattaccaacacgcgaagattattcaaaagaacgtaattttcttggcggtacggttggccggattgtcgggcgaattcggggccacgtttggcaacacggtgacgttaaagtcgatttgccgatgaatgaaggcaagaaccatattcatggcggagatgatgggcttgatcgtcaagtttacaattttcgcaccgagcaaactgcaacgacggcgagtgcgagctttacttttgtcgatccggccggacacaacggttatcccggcaatcttaaattacaggtgacttacacgctgacaaacgcgaatgctttgcaatatcgcgttgatgcattgagtgatgatgagacgctgtttaatccaaccaaccatacttattttgcactggatcaaccagctacgattgatgaaaccgtactgacaattccagcagatacctataagcccttggacgccgaacatcttccggatcaaggctggcaaccggtggcgggtactgtattggattttcgcaacgggcaaaaactgggcgatgtcatccatacgcgtgccgatcaaattacatctgaacgtggcattaatcacccgttcctcctaaaaaacggcaaagcactagccgccaagctgcaaactaaaaatcacacgatgacacttgtcaccactgcaccaagcgtggttgtgtatacagccaatcatttcgatggtacaggcgttgcgcataacatcaagcaatttgatggggtagcacttgaatgccagtatccgccagtaagcggttcggatttatccgcgatcacgttgctgccaggtgaaccatttaccttggcgaatacttggacgtttgaataatagttaacgacgaaaggctctttggggatgctcaaagggcttttttgtatgctggggtatcggtgctggctttctgcttgttgaagcatgggtgttgtggtgttagggaatcgaaaagattgagtttatgcaaaccgttatattttgcagcgggtttatcctgatatatacttttaggaaatgaaagcgattacgatagcaagcttttaaattaaatattctcgtgaactaatatttaaccgctgtgattaaagatgcagcatgaaagtggggggttcgctatgaaaaacggcttcttgaaattgccactcagtgtacagggaatcgtcataatggttgtctggttggcagttaacgcgatttatatttggtacaactggccggttaataagtttgattttgcgccagcttttttaccggtgtttcctgttttgatcagttccagaagcggtgtcgtcatcactaattggcaaccgtgtatggcaattattgttggattgacgagttggtatctcatcaggcaaacgcgaatgcaaaagacaaaatcgccgctatttattcgcttgatacgtcacctgttaccggtttggctgtttatggggacttgttttttattattgaatcattcattaacctttcaattactgacttagggtgggcgccgttagcaacgattacttggggttcaccgtatacattattcttcttggcaattctggttattgttaatttgattttactgttcctgaatcgaaccaacacattagatgtcgatatttttgatatctggcatttgtcatttacaggtctattggctatttattttggtgctaacctttttgttgctaccgtgttggttatcttcattggcgttttaaaaattatcaattccgatttgatgaagccgactttcaatgacttgttggacgactgggagaacccgatgacgacaacgcatttaaactacatgatgaatcctgtgatcatggtgtttgataagttgtttgacaaattgttcccatggttggataaatatgacttcgatgcggcaaagctaaatgaaaagatcggattctggggcagtcgttttgccattgggatttatctggggatctttatcggtctgatttcccatcaagatattaagtccattacgacgctggcctttatggctgcgacctgcttggagctgtttagtattattggttcgtggtttatcgcagcggttgagccgctatctcaaggggttgcggattttgctaacaaacgcttaggcggccggatgcttaatatcggacttgactggccattcttggctggtcgtgctgaaatttgggctgcagctaacgttttagcaccaatcatgttgctggaagctttggtattgcctggtaacgggatcttgcctttaggtgggatcattgcaatgggtgttaccccagcgctgttggtggttacgcgtggtaagattattcgaatgattgttattggtgctatcgaactgccactgttcttgtgggccggtacactttcagcaccattcattacccacacggcacgtgctttacatgcgagtggtattcctgccactgggttaatctcttcgtcaaccaaggaaggcccgattgaacagttcattgctgttttggttggtaaagcttctaagggcgaaatgatgatgattgtgtatgctgcgttggcattaattgcttacactgcattgttcttctggtatcgtcatgaaatgatgaaacggaatcagaagtactctgatgagggtaaagaggttgctgatgatgttaaatttgtcgcaacccatgccgctgctaattcagcagattaatgatgaagcatttaaaccattctgttaggtatcattgatggtgattgtgctataaacagctctagacgatgcggtctagggctgttttgctataaaagctttaaaataatttggcatataaatattcgtaaaccgggtgtatagtaaaaatcaaccaattcgaattttggaatcctaaaatggtgagggcgtggagatacttgcagagactagcatttctcaaatcatggcttgtttttatttgtgtcggactagtgggcgctgagttgacggaacttgctactaagattgatcttaatgtggcagcctatatccgcctaatcggttacttactaacgcttaaggtcgctgatgtgataacaaagaaagttgagtccaataagaagactaaacctcgccaaaattgagcatggatggatgcatgctgaaatgataccagtaatggaatagcttgaaggtcaatactaacgcgtggctggcggccagcttgagtgttcaagcaacagagagaaaaagacggacagatttcgagttgaaatctgtccgtctttttgaggggtggatgatagttcatagtggcatatcattatcgacaagttttagttcgtggatttttgattcatccgatgtgctcgccgttttttacgatcaaaaacgttgtcaattttgagtaactgataaagtgcatagcaagcagttaccatgaccgctacctgggtgaatgtattcttgaaaatgccgtttaaaatggtgacaagtgtgacgatgccgagccaaattaggtaactttttttacgatttgtcatcaaaaaggacctccattaatcttatcctacctctattatagcttaattgaagcgctaaaactagacaaaatgaacgataacaaacaaaaaagaacatacatgagcacgtttcgcgttgacatcgcataaaatgaagggcgatagtggtttactaatcgagaccagtaaacggctttcgtccttcgcgtctaatatgaatcttccgtacattgtttaataaatcggaagttttaagttgactttagcagtcaaagtttaacggcagcagtgtaaattcgcttaaagaattgatccatggttgcttgaggcttaagtacattggtcaaaccgacaacagctttcttttgtgcttgattaatgcccagcaggccagtgtagcctagaacgctgccgctgttaccgagccatccgtctgccagcttgtaccagccatagccgtatccagcttcggcggctttaaagatcgtcttccaactggccgcggttagtagttgacctgtcaaaactgcttgggcaaatttttctaagtcggcaaccgttgtgacgagtccgcgatcggcttggttttcattacctttaccagccacattgggattgccggctatccaatgataactttctgcaaatgcgtgggctgtgccaagtttcgtattggttaagttcagcggatcatagatttgtgcttttaagatcgcctcaagtggccgttcattcgtcacgcgatctagaacttcgcccaacagcagtgcgttcgtgctgctgtacgcggttttgctgccgggtttaaagttcaggggtagatcatcaaccacagccagtaccttggctaaatccatgttttgactggtatgttgattgatttgcagcgctaaccgttcggccggcagtgtgtcgggagcgttggctttaaatggtgcagccatcaaagttagataatctggaattccgctttgcatggtggctagttgcgctaaggttatttgctcggcctgttgatactccggaatatacttagacagtttgtcagttagcttgacggtgccggcttcaacaaactgcatgagcaaaacaccgaagaactgttgggtgacagttccggcaccgcttattgtatgggatgcaaacggtaccttcatgtcaatatgggaaaacccctgcgcgtctgctgctaattctttatcgggggaaacaactgctacagcaccgttatagtgttcggtttgtaaggaacgactcaacggtgattcatctttaagaacttctggtgttaccattttgatgcctccaagcaagattgacttggtcgaactttagctgtgttatctgaaacgtggcgttttcggccgttttggttgtgttttaatctaggtgattgacagtgactagcttgccagtaacgccgactttgatgccttgattgatcttgtcggtgcggctggcatgaacgacttggaacttgttttgcttaacaatcaatgggttgtcggtgtgatagccgactggtaacggttgattgctaccgcgaattaacatgacaataaatttaaatccgcttgcatgagcctcacagggactgtaatgcaaagtgtcactgaagaattcgaccacagtgccagcagggacgaagaatagcttagcgtccttttccgcgttaaattgaccatcatgcatctgcccgcgtttaccgatcaccatcacgacatcggtgaagaaaacattcacctcgctgccttggtgaaattcgactgctgtcaaagcctcggcgtgtccggcacattcaccggcttcgattggcagaccggcaaaaacatcacgaccaatctgttggaccaccgggagcttttccattgcggggttggaaggaatatagcgattggcagcagtcggagcggggatggggacttgctgatccatgaactgttggagttcgctgacgtcatactgtgtacaggtgaccccgtaatcggaaaacgctgaatcggttaactgatagatcgtcttatccggattcagagcttgaatcttttcgaaagttgacatttgattgcttctttcctggtttaataagtttcaatggtgactttagcaaaatactcggcaaacttggcggggttgacaaaaccggtttctgcttccatggtgttgagcatgccggttgtcattgcggttttcataatgtcttcatcggacttgccatcatgaatgccaattgccagaccggcaagtgttgagtcccctgagccaacgggattgacaacctgaatcttaggaatcgcggcgtggtagaacttatcttgatgtttaacaaaagcaccggctgaccctaatgaaacaacgatccaatctacgccgtcaaaaatcggatcagtgagagcttgtttcaaggttgcgtaatcagtcttatccaccgaacgattgagcaggccggcgagttcctcttcattaggcttgattaacagcggctttacgggtgcttcaagggctgatttcaaggttgcaccggatgtgtctagcagcaccttcacgtttttggcaccggcatgggcgatcatttgcgtgtagtaatcttcaggaagtccttgtggcattgagccggaaatcgtcaacaaatcggtctgatcaagtagcttatcaaagtggtctaggaaggcacttgcatcttcaggcgcgatggttgggcctgcttcgagaatttcagtttgtttgccgccatcgtgcaataccgcaatcgagctgcgggtttcggcgtcaatgggaaagaagttatgggcaatgccatcgtgatccaactgattttccagccatttgccaaaataaccgccgatgaagccagtggccgtgatgtcatgatcaagcagatgaatgacgcgggaaacgtttaacccttttccaccagcagttttgcgaacggttttaacccgattgaccgtgtcgattttaagatgatcgagtggataggaaacgtcgattgagggatttaatgtaaccgttaagatcataatgagttttcctccaaaagtgaacgtgagcaggttgcctgctaacgtcatattagtgattgtgttagtcggttttcggttaataaaagccgacccctcaaggaatcggcttttatggtcttacacgaactattcgtggctgaccttgtccgtccaaggagtagcagtatccgctaaaaccttgttcaaacgatcgatgttagctttacctttcgtttccagccattgcttgccggcagcttcgccttcagcagcaaatggcttaacgcctggcttccaggttgcccggccgcaaagcacaccgttaaaggttgaaccggattccttagcgaatttgagttcttcaaggaacaattcgttggaaacaccagcggacaagaagatgaacggcaagccggttgcatcggactgggctttgtaatatttggcagcttcttctttggtataaaccggggttacgccttcatcggtgaagccttcaacaaacttctgatcaaccggaacttcgacttttagaacggagacattgtactgcggtttgctgaattccttggtgatcttgatgaccttgtccggcttaaccttagcccatgcggcggtgccagtctcgttgagcgtaccatcataggaaaccagttccaggaacagtggtaaatcattagccttagcttcagcaccaacccgctcaacaaacgcatatttacgatcgttgatactatcaggttcgtcagggtcaatgtatagcaggaatttgactgcatcgccgccttcgttcttgatgcgcaaagcactttggttatcaatcagatctgggaaacggccaggttcagtcgcatcgtagccggtcttttcataggagagaagcaagccggcttgtggtgcacgaactttggcagctggcaggccatattccggatcaagcaaaattgaactggcgtatttggttagttcttcagaaaccgctttcttgaaatcgacaatggtggtttcatcagctggcttgttcgctgcagctgcaagcattttctttaaagaaccgcgttgatcaatggccagcgcggagataacgttattttcgtcggaaagtttttgcagatgcttgaattggcccgcagtaagggtgactgtcatgtaaaaaatgcctcctaggattttaatgtttaattagtcgtgatagacgccttcagcccacttttcgagttcagcatcaaagaaatgcgggttgtctttttgatcaggatttggtttcgcgatgttgtcgatcttatcaatcaactttttattttcaggcgtttctttgtaggtggcatccagataagctttgacaatatcttgaatgaggtgaacgccgacaactgcgccaccgatacctaagacgttagcgtttagctgttcgcgagcatagacggctgaggtgacatcatcacacatggccgcgcggatgccttcgtttttatctgcggctgttgaaataccgatacctgtaccgcacatcacgataccgagatctgcacgaccatcagcaacatcttcggcgactttcttaccataaatcggatagtgggtacgatgcgtgtcataggtgccttcatcaataactgtgtaacccatgtcttttaacatgtttgaaatttcaatcttttgcatcgtgacgatgtgatcgttaccaatagcaataatcataagtgtgaagcttcctttctatattgggtgaaagacggcgttaaatcattttttcaagcatgtcgagccggatttgatgacggccgccagcatattcggtatccagataacgttggatgatgaccagtgcgcgatcataacctgtaatgccggtaccgatagcaattgccttggcgccattatgttcagccgtcatgtgggcagtgttttcttcttcaacgaccgcggtaaccatgcctttgactttgttagaagccatggcagaaccgacaccgtaacgatcaaacatgatggctttgtgcgcatcactgtttagcagctttttggtaactgccagtgaagattcaacaaaatcttcagctggttcaggcgtcacatccgcgacccgatattgatgttcctccaaatatttcttaacttgttctttcattgcaaagccatctttgtctgcaccaataatgacatccatgatctattctcctttttttgttttgtctgtaataacatgcgtatatgtgttgtaatgttgccgatcgtcagcgctgattccgggatcagtgataagcccgtctgtttggtcaagatcgtagaaactgtagaaatcttgccgattaagtttgaaatgatccgcagcaacaaatttcatccccgcattgttcaacgcaattcgctgcgtttgaccttcttcggggctggcgttgctaatgtgattgtcagcgataccgttaacactgatgaatgctttggtcgttgtgaggtgagctaacatctcatttgccaagcttccgataaaggctcctgatcgttcgcggagctggccgccgatcagttttaacgagaagtaatcggcgcggtcctgaaagctttggaagacgggaagactattggtgatgatccggacgtcaggtttcttgaggtactgtgcaatcagttcatttgttgtgccgggcccgatataaatcgtatcgcctgaagtgatgatatcagcaatggtagcggcgattttacgcttttcgttgacgtgaatggaccgcttctcatttctggacaattcagttagcggtttaaaatgggtactttgtgcgccgccgtgaatacggactaactcatttctttcagcaagctcttccagatcccgtcgcacagtcatggttgaaacgcctaaactttcaccaatttcgttaacggtcacaatccctttacgatcaactaaattacggattgttagcaagcgctcgtcttttaacattgactcacctcacaaaaaaatgttcgttgttgtttgattttgtttcttattacagtccttaagttaccactggccacatgattcgtcaagaccatagttgcggtgtttacgactatttttatcgcgtgtttttataaaaaaagaaataaaaagcgtcataaaaatatgcagatatagccgcatattagtaatcgaataaacagaagacaacaggtacacacagaaatacggtgcctgccaaatatcggttgatgatttcacggattcaaacgactgattcatttagcgtcaattgaccaagaacggaactcaagaagcgcaaaaaagccccaaacatttgcatgcttaggactgtggttacgttgttatctggtagaattaattggtaataacttgactattaggggcagtgtcactgttaaaacgcgtaatatatagtagcagtcatacgttaattaagctttgaaagttttaataaatcatccgcttgctggaggacagcaatgcgtggcgtgacagcgggtgatggtggcgttgtccaccccgcgagtgcaaaggcaacttttgcatcggctgcggcttgggcgtcagtcggcgtatcaccgatgtaaaccgtcgtgtcaggttggccgcctaaccggttacgtgctaaggtaattggatcgccaaagggtttgttgcgtttggcttcaccggcgacaaccactgtttcaaaatacggactaaagtgatacttcttatcttcttcgaggaattgcggtttgtcttttgaagtgacgagaccaagcttatagtggcggcttaattgcgttaggactttttgcatgttggggaaccaagtgacatggttgagaaaagctttcgagtcttcgcgccattcttcatgcaccacgggaatttctgctggaccgaagcctagctcttttaaactatcgacaccagcgcggccattggtccaagtcaagtcctcaatggcgattttgcggccatggcggcgtaaagttttttgaagcccgtaaaggtaaccttcaacgttgtcaagcaaggtgccgtcaatatcaaagataaacgtattcatattcttcctcctataacgcttattattgtaacaagtaagcgataacaaagaaaggcgtaaacatgcgatttctacacacggccgattggcatattggcaaaaaactaaacgattttgacttattggaagatcagcaggcggtgtttgaacaattggtgaccgttgccaagcagcaacaagtcgatgctattgtcattgccggcgatttatatgaccgcgctttacccagtgaggccgcggtggcaacgcttgatcatatgctggtaacgctaaatcgtaagctgaattatccattgttggtgatttccggcaatcacgactcggctgtccgcctacgtactggccggtcatggttttccacaactaagatgtacgtcaacacgcaattagccgaggcatttaccccagttgaacttggtgacactcaatttttcttactaccttattttgaaccgtttgctgtccgtgattattttcaggatgcaacgattaccaatgtagcacaggccattcgcccgattgttgccaaaatgaaagcccagtttaaacccgatatgcggcatattttggtgagccatttttttgctgccggtagcgatcatagcgcttcggaaacaaaggttaacgtcggcggattggatgcagtcccgattgatgacttggcagcgtttgactatgtggcgttaggtcatttgcataatcataatgcgctgcacgccgaacctaagattcagtatagtggtgccttattgaaatatgcggtcgctgaagccaagcaggaaaagggcgtctacattgtcgatactgacacgatggcgcggacgtttattccgttgacgccacaacatgacttgattgagttgaaagccagctatgcggaattgactgatccggatttttatcgccagcaggaccgcgatgcttatattggcgttgatttaaccgacacgcaggtgattccgaatgtcatggcccagttgcggaagatttacccaaggattatcagcctgcgccgtgaaaatggggtcaccgccgtaaaaccgttaaaacaacggcagcgcgatctcgatccgctgagtttgttgaagaatttttatgctgagatgatgcaaacagatctgacagcggatcagctgaagtgggccaaagcgggacttggtgaagcagaaagcgggcagaaacagtgaaacttaaacaattacacatgcagtttttcggaccctatgcagatgaaacagttaattttgaagattttcgcacgaccccgctattcttaatcagcggaccgactggcagcgggaaaaccacgatttttgatgccttagtgtatgcgttatacggcgagacgtcaggggaacgcgatggcatgcagatgcggtccaactttgccagccaccatgatctgactaaaattacgttaacttttgatcatgacggtaaacattatcgggtagtgcgccagccgcaacagatacagcaaaaaaaacgtggtgatggactgactgaggtcaaagcaaaggccatattggcgattgcagatgctgataagcaagtggccgaatataccaaaaaaaatcaggtccaaagccagcttgatgcaattttacatcttgatgccaagcaatttcggcaaattgttctgctgcctcaaggagactttcggcgttttctagatgccgacagtaatgccaaagaagatttacttcgggatttatttgggacccagttgattcaacgctggcaaacagctatgcaagcacaaaccaagcagcagggagccgcgattcaggatcaggaacggatgctgaatttgctgacgtcacagtttgaatttgccacgccgccatctgacaacgcgacgatggctgacaaattggccttgatgcgtcaggaagtaacgcagcaagcaacaaccgtcaccaacctgcaaaccatggcagaccaacgccaccagtgctatcagacggcccagacagctcttcagaccggcaagcagctggcacaagcatttgaagatcgaaaacaaactgctgcggctttggcacaacttgctgaacagaagcaaacacagcaagaccgtcttaagttaatggaacggttaacctgggttcaagaacacgaggcagctgagcaacgggtgcaaagagcagctcgtgatttaacgatagccaagacgcaacttgtacaaacccaaacggcaatgaaaaccgctcagcaggccatggatcaggcccaaacgaaattaaatgatttacagcagcaggattcggccattgaagccaaaaagacgcaacttgatcaattgcaatcggttaaacagcaactcgttgcaattgcggatcaagaaaaacaagtagcccaacaaaccgccgcagttgcacaggcagaagcagcgtctgtacaggcgcaaaaaaaattggcaaatgatcagaaaaaacttgatcaatatcaaaccgagttgaaccaactagcagtgtcagatttggcagatcgagcagctgaccataaacaattagtggcagcgctgaaaccggtagccgctaattatcaagatgcgcacgctgaagctgaacaacttgccagcaagctaacggacacaaagacgttgctgattcaggcgacaaatgtgagtcaatctgccgagcagcagttgaatcaattgcaacagacccagatccgacaacaaattgcccaattggcggctaagttgacgcccgggaccccttgcccggtttgcggcagtgtcgagcatccacacccggctgtagccttggatgaaccgctggtgactgaggctgaggtgaaacaggctacccaagcacgccagcaagcagcggcaaaagaaacgactttgcaagcccaggtatccaacctagaagaacagcacgctgccgctaccaaaaagtcaaatgtagcaaagaacagtttttgggcgcaggtgagctcaagcatagatgcagtgagtccccaaagcgaacagtcagatgttttgaaacagctggcaatacttgaagaaaaagcacaggctgcagtccaagcgttatccgccgctcagatcaggcaggatgcgctgaaaaaagcaataacagttggtcaaactgttgtgagcgcagatgatcaggaaattcaagcaacccaaagtgcgcttaatacagcgaagattgaggcggcaaaagctaacagtgtactgacgaccatgaaagcaagtttacctgcaggcacgactgatcttaagacagtaaccgaacagtcgcatgtcttgactgaagcaatcaagacttaccaggaacaattaaaaacggcgcagcgtcagttaagtgagttcgatcgccagttagcaggcttacatgcagatgaacgccatgctactgaccagatcgcgacactgaaaaaagagcaccaggaagcagaagatggctttttatctgcagtaactgattattttggttcggatggtgtcgcaaaatttgctgccatgcgcgagcaattagggcaattaccacttttgcagcaacaaacgcagcgttataaggatgacgttttaaagcagcagacattactggcagccgctaacaaaacgattggcaatcaaccgcaacctgcccttgatcagcttgaggctcaagcaagtgcagctgaagcagaggcaacaaaagcacaaactgccttcattgaagcaaagcagaaacatgatacggcccaaaaattgcttgaacaggccgcagatattttagcggccaatcaaactgctttggctgcctatgccgacttgcagacactgaccgccgttatgaacggcaatggtcccaagaagcttagtttggaacgttacgttttacaagcctatcttcaggatgttttggatgttgctaacactcgcttgcaagtgctttccaaccagcgttaccaatttgtgttgcatacggacttgggaactcaaaagatccattcaggtctggaaattgatgtatacgatgatcaggtgggtgaacgtcgcgcagttcaaacactgtctggtggtgaaagctttattgctgcgttgagccttgcattggcactgggcgaggtgattcagcaagaaagtggtggcatcaatattgatgctttgtttgttgatgaaggcttcgggagtttggataccaatagccttgatgtggcaatgaacgcgcttgaatcgctggaaggcgaatcgcgattgatcgggattatttcgcacgtgacggaattaagggataatattcccgatcagttgcaggtgcagccagcagggacagggcggagtcggattaaggtgatgcatatggcgtcggcgtaagatggtttgaggcccacttacactccgttttctaagcggccctgattgcgctcttaaacgcgttcgccaacccagaaacctgcacataaggacctcagatcccaatggcaaagcccggccattgggatctgaggccacttatgctccggtttctaaccgggttggctcacgctctgaaacgcgctcacagggccagaaacctgcgtgtaaggaccttgagcctaaatggcaaagcccagccatttaggctcaagcccgcttacactccggtttctaagcggccctgttcgcgctctgcaaaattatctgtgtcatttttgtgtttaagtggtataacagaagttgtaagggtcataccttctaactcacaccaaaaagaggcgagatcacatggcatcattgagcaaagaacaaaagaaagctttgatcgctaaggtcgaaaaggagcgccaagaacatcctgaaaagaagtcaaagaagtctggcttcgagacgattgacgaagaagcagaacgccttgaaaatgaaaactaatatctattaagttatgagccgcaaacatatacttgtttgtggttctttttttgtaagcgcgagccggcgcggttagcaatcggagtgtaagtggccttaagcgtgatggccggtttttggccattgcgcttaaggtccttacacgcagattgctgcgctggggagcgcgttatagaaagtgagcgtgagtcagcccggtcagaagccggagtgtaagtggccttaagcgtgatggccggtctttggccattgcgcttaaggtccttacacgcagacttctgcgctggggagcgcgttatagaaagtgagcgtgagtcagcccggtcagaagccggagtgtaagtggccttaagcgtgatggccggtttttggccattgcgcttaaggcccttacatgcaggcttctgggctggcgaacgcgttatgctggaggctacctgattacttacaactctctggaatggcgaagctcgcaaatggtgataactatgaagattcgaggtactgcaaggccattttggcatcatcggtatagctgttattgacaaggaaaataaagtgaaccatttatgcgtttcctgttttaaaaacttttttcggaaaaatttagcacttggcgttcacaagtgctaatttgtggtataactataggtggagcgagggagaaggaacaagagctccggagctaagatcgttctcctgaatcccagaagtctctgtttgaaaggaagttatctgttatggctaatgaagttatgaatcgtcgtaataatgagttgatgaatgatgtaaatgatccgttctttgacaacttggcacgtcggttcttcggcccggtatctgactggatggattgggcaacaccttccattgccagcacggccgtcaacggattgctgactgacgttaaggagaccaaggacgcttacgaagttcatgttgatgtacctgggatcaataaggacaacatcaagctgaactaccatgatggtgtcttgagcattaatgttcacaaggacgacatcacagatcacgccgacaagaacggcaacgtcatgatgtccgaacgcaactatggcacgatgagtcggagctatcagttgccaaacgttgatgacagcaacattaaggcaagctacaaagatggtgttctgaacatcacattgccaaagttaactgaatctaaggagtctggtcacaacattgacattcagtaatgtttatcatcaggcggctcaagattcacgaactgcattgcaagcatgatcagaagcggcaccactgtcgttgatgggcaaaacccagtagtaagcaaaatcagtcgatgagaattgcagcagttgcagtgatcattgaaccgtaagaaatcagtcccatgatgcgtacgatcgtggggttgatttttttgctctttttgcaccgagtgaggttggtttttagccgattcgatttacttttccaaattatgaaactccatggtaagctattttctatgatgacaaataacaaattaatggattggccgcctgaaaaagttgcggcatttcagcatgcactcttggattggtacgatcaccatgcacggacattgccgtggcgtcaagaccatgacccttatcacgtcatggtcagcgagttgatgttgcagcaaacccaagtgcaaaccgtcattccgtactacaaccgatttatggcgcagtttccgacagttgaggcgttggcagcagcaccggaagcgacggtgctaaaagcttgggaagggttgggttattactcacgcgcccgccgcttgcaacaggcagctaaacaaatcgtgaatgactatggaggtaagtggccgcaaacggctgcggagttacagacactggctggcattggaccgtatacagctggggccatcgcatccattagttttggagaggttgttcctgcgattgatggaaacgcatttcgggtctttgcccgactgtttaaagtggatgccgatattgcgcgcccgcaaactcgaaaagtgttcgatgacttgattcggccactgatgcccaaggagcggccaggtgattttaaccaggccgtgatggatcttggttcaagttatatgtctgccagtcatcctgatcccgcccattcaccggtgcgcgcgtttgatgccagctttcgcgatggtgttgtgcaggactacccagttaaaaccaaaaagccgcggccggtcattcatcgttattttgcattggtgattcgatccaaggccggttacttgcttgaacagcgtccgggtaaggggatgttggctgatttgtggatgttcccgttaattgatatggccgagcttgaagccactatggaaagcgaacagttggatgaaatcagtgctcggtttgcagacttgtccggaatgactttaacttttgccgatctcggtcgtcctcaggtgcaacatactttcacccatcaacgctggcaattgactttaatcggagcggatgcagctgctgccgaattaaaatttatgccagcacggtgggtaccggttgaagattttggtaaaatggcacttccgaccgttcaaaagaagcttaatcgggcattgggattaactgagccgggataatcatctggtgtagcagcgcaagacaattgttaactggtttggaaaaagcggcggtatactgtggtcatcaatgaaagcaaaggtggtcagattgacagttaaggtaactaaagacgtcacttatggcgatgcaccgttacaaaagctcgacttctatgaaccggataaaccaaatggagcagccattctagatattcatggtggcggctggtttcgtggtgaaaagcaaaaagaaagcgatatggctaaacggttcgccgcattgggttatcacgtggcggttcctaattatcggttggcaccggcagacttttttccagccgcacgtgatgacgttttagcggctttttcatggttgcgcacccatgctcaagttgagaatctgggtgtcttcgggtcgagtgccggtggatcactagccgttgatgtcgggctggctgaaggcgtaccaactgtttcttggtcgggtattttcgatattcagcaatggtttgcggatcatccagcaattgtggctcagcccgacaccaaaacggactttgttaagacggccagtgccgagattgatcaaggtgggcgcaatgatccattctacaagtggttcatcttgaattatgtcgatgcagatgaaacaaaattttctcaggttgagccatttgaccggttgacggctgatgcagggccgctgtacttggctaattcacaggcggaaattattcctgttagcgggatttatcgattggctcaaggggcagcaaagctcggtgtaccggtgactttgcaggtgattcccggtggccagcatgcagaagggtacttgtcggcagcgtggccggggacagtggcgtttttggcacagcatttattgaagggatcaatttgaaaacattagtgattgtcagtcatccagacattgaaaaaagtaacacccagcagtttttaaaagccagtgcggcaaccttgtcgcaggtagcgtggcatcatttggatgtgaatctgccttttgatgtgcccgctgaacagcatgccattcaagctgctgatcgaatcgtcttccagtttccgttgtactggtatatggcgcctgccagtttgcatcaatggctcacagaagtatggctgaagcagtttgtctatgatgcacatggtgggttgctgaggggaaagtcactgggattagtggtaagtttcagccagccagaagccgcgtatcagcttggcggcaaggtgggctttagcctcagtcaatttttaactccgtatgtggcgcttgcagaaaaaacgagcctggatttgcttgctcctttgacgatttcgcagtttgccaatcaaacggatatggctcaccaacagttgctggtgcggtaccagcaatatctgaccctggttcatcctgatgatcctgacgaacaggcgcagtggtatattgatcgcctgcaagctaacccggaaacgagcatactggcggatcaacttgctgcccaaaccgatgaaattgaccggttgcggctgactttacatgaattaaaggcaggtgagtcagagtgacgaccgatgaacaatggcttatcgagacggctgcccaacatcaaaaagacgcggcatcgtatgaaaatgcagcgttttttgcggctttacagacgtttgtcgccaagcaagctgagcgccgtgaacaatatgaagccgaaattgatgggcgcagttggaatcatgagcagtggtaaagttcagtctgacgacggagggacattgcaaaacgatatgctatgctttaattagcataaagtgttggaacaacgtgggatttaagcgcgcggttcacgctcacattaacgcgttcgccggcgcaggagcctgcatgtaaggaccttggacgcaatggccaaagcccggccatcacgtccaaggccgcttacactccggctcctgaccgcgccggctcacgctcagaaaaaagggagtatcaataatgcaagcaatgtttgatcgtcttcaacgttggtcgtggttgcgcggcctgcttatgattttgattggtggctggattttaattgatccgcatcaggtctaccgaagctttctgtggattgttgcagcagttctgattattgccgctattcctaaattgatcgatggattttctgcgcacaaaagttctggaacttatgggacatcgctttttgccggaggattttacctcttgctggcgttgctgattccggcaatcgtcaagccgctcatgagtctgggaccgttgattatcgggattatcttgatgatctacggggttaacaagattatcggcgctcgccagcaacagcaatatgtaaatgtttcaccatggtcgacgattatttatggtgtggccttgcttattatcgggtttatcatggcgattaacccgtttaagacggtgatgatggtcttcgccttgttcggcggcgtgcttgtggtaatgggcattctgcaacttttcactaaaaaaagcgattaagctgactaagcaaaaagccacggaggaatttatccatggctttttatattcgcatcacaactaactaactcacaatataaaaaacaggacccatgtatgcgcaatatcatcgcaacattggtcctgttttttttacgcaatggtggcaaggatactcaacgagctgttctgcggttagtcatcggtttattgtcgtggatacacaatttgattagcccaatgattgatgggaccgtatttgtggccaaccggaattggatggccaattgcctgattagtaaagcgtttggcaatccgaatagcgtcttcaacatcattacccttgccgatttcggcggtaatcactgccgaaagtgtatcaccggtgccgttaacgcggtccgtatcgtgataaggttcgctcagccaaaaagatttaccactttccagcaacacaaaatcccgaacttctttttgagtcggatcgtcatgggcaccttttaatacaacgtttttggctcctgatgcttgtagctgatgggctgcagcttctgtagcagcatcggtgtcgagtttcatgccggtaagatgttctgcctcatagtgattcggagtcaccacggttgctaagggaatcagttcatttttgacggcatcgtaggcatcttgttccagcagcatcgcgccgtgcttcgtgataatgaccggatcgaccaccagcgcaccgaaatcatactgttgccagtttttgataatcgcttgcaccaatgccttatcagccagcattccggttttagctgctttgattttcaagtcagcagccaaggatttgaactgcgcatcgatgaacggcaccggcatcaccatgctgtcttggataccataggaattaccggcaaccgccgcggtcaaaacggtcgcaccgtaaacgccacgcatgaagaaactatgcagatctgcttgaacgccggcactgccatcactgtcagtaccgccaattgtcatcacttgtggaaattcgttagccatcatgatcatctcctgataaaaaagtctgaactctcatcagcatgtccattcattggaaggtttgcgctaatgccaatcgttcatctgtacggttagttaaaagcccgtttttgaggtaaaactgcttttagccattcgccaataaatggatattgccgatttaattcaatcacctgagtttccggatctgggtatttcaggtaaatcatattattgtccggattaaccattacagtaaagagtttttgattgggcagcggtaattcatatacaccttggtgactgccttgccgcatcaaaatcgcattactggaagcaatgacgaacagttcgtctaacgcaggggagtttgtcccggcagaaacccgcacgaccagcttgaggtgatggttgaccagttcttccggaattgtggtcgaggcccattcaaatcggtcacctttaacctcttcagaacctaaatctttccaatcgtggccgtcttcgtccagaacctggtagtcgagaactttgctatcccgatcaaggttagtctgaatgctgaattcgccggctttaacaaccgtttttttggcgactaatggtttgagattatcaaagcgggttttaaagtgtaagccgttgattggctgcaaaaccgtttcgtcaatggttgcaaattgatagccgccttgattaagggccttggttaaagcagacagtgctttgatttcatcggcatcgtaaggcagcgcgttgctgtcgcttgccgtaatttgtaacagggttggcaaattggcggctttcagggtggcgcttgggcttagcggatcaacaatggttagcaggggctgattgtcttcttcagttgcctgaataagcgtgatttcactgtggtgaggatcgctagtcgtgtctttaaaccacaatgtctgtaaaaagttagttggaatggcagcaatattttgcaacgtttgatagagtttgtcacgcatcaagcccgtgtaacttgccagtaacgcggttagtgcatcatcatttgaaccccataaaggcgaatcggctagtcggtcagcttcggtttgatacgcggtgctgatttgttgacgtagctgtgagacatttaacggttttgcaattagggcagccaaatgtgtgtcattaagattaagcatgtgtgcgccctccttcaagctttaatgactgcatgaaatcatctttcaagttggcaagaacattttcaaactccgcaacggaactgtaggtgctcaagacagcttgatattcataacgggtaatggctgcagaaacttccaattcgcgtttacgtttatcgaaggtgtcatcagccgccagcttttctttatcaaagcgggccttaagttgcgaggcatcggtttttgatgcatgggaagctggggcatcggattcatcacttggatcaatgaaatttttcaaaagtccgcggaagccaccgttaccttgggcggattgatcgcgttcaggtgctgcttcagcttcaagattatcaatttgcgtatgcagtgaatcaacatcgcggtaaacttccttgcgcatggcgtccaactggcgatccagatagtgatcaggatcatcggaaaaggcttccagttgcggcaggatcttgcgttgttcatcggttgactgggtaatcgcgcgcaaaatgacgttaatatgaccaaaatcgcggcggtgataccagttgccaaaataaatcgtcccttgatcattgacttcaaaaaacggaatatgttgccgcaagaaatcaataaacccgatttgtaaaaaatcatgcagttcggcttgggcgcttttgtcgtaagctaaaatgtagccaggcgcttcttcaatatcgaggcgcaaattctctgctgtggcatcgattccctggtaaaggcggtaacgtgattttttatgccaagcatcggtaaaatcactaaagaatttcttttggtaagtaagactcgtttcgattgacatataatatcctctcacattctgtccaattattttaagtgtaccgcataaacgggcatataaggaagttttcttctcatttagagctaagaaggtcaaatcaaccgttttaaatggatgcatgctaaaatgagctcgtgtagggtgttcgggtttacgaaatgaggtaagaaaatgaaaattgcagttttgggtgcgactggacgtgccggaagtgccattgttgccgaagcgagaaaacgcggtcatgatgtgttggctgtcgtgcgcgatccgcaaaaagctgcgcgccggctgggccaaaccgttccgacgctggtgaaggcaccactagatttaagcgaagcagatctagatggtgttgatgccgtcgttgatgcgctgagtgttccgtggggctctggccgcggctatttacatttggattttgccacgcatttgattagtttgttgcgtaatgcggatccgttagccgtttttattctgggaagtgctagcttggcaatgccaggtgccgatcatccgatgattcttgattttccggaaagtgctgcgagtcagccatggtatgacggtgcgaagtatcagtatgatgaatatcgatttttgcagatgaccgataacgttaaatggattggtatatccgccagcgaggcttttccaagcggaccggcaaccggttatgttgcaggcaaagataccttactggttggcgaagatggtcagagtcacatcacaacaggtaatatggccttggcagtcttggatcagctagagcagccaaccgctttgcaagatcggataaccgttcgcgatgtggatgaatgagcggtaatagcaaccaaaaaaacacgatttacgcaggggcaaagccttgtgtgaatcgtgttttttggtgatttttgagatgaatgagttgggaaaacgatgggtggttagccgcggtatggtgggttggtagtggtggttatgcgcttatcaactgataaaggtttggggatatagtttgggtactagactaatttttgtgttgtttgggggtaaggctttttagtttaggcagttaagggagctgatattgcgtttttatgcggtcccccggcacagaagtctgcgtgtaggaaacttggacacaatggccaatgtgcgaccatcacggctaaagactgtttgattttaagaaagtagccgggaggacggaaagactttctggtttaggcaattaagaaactgacattgcgttctataacgcgctcacagtcgcagcaatctgcgtgtaaggacctctagcctaaatggccaaagcccggccatttaggctagaggccacttacactccgattgctaagcgctcctgttcgcgctcaccataacgcgctccccggcgcagaagtctgcgtgtaaggacctcagacgcaatggccaaagcccggccatcacgtctgaggccgcttacactccgacttctaaccgcgccggctcgcgctcaacaaaaaaacaccgcgtattgggggtacgcggtgttcccgtgtcagcgccattgggggtggagctgacttatttttactttggaggagtaaaaatgaaaaaagttgggttggggtagtagtaagaagggggtaaacttccttgctacacttaagagaataatcgctaattgtgaactttttatgacgttctggcataaaattttagaacggacgtttttttcgtcatcagtgcacttttttcggccgaatgactagttattaaaaagaagctgtgagatgtcagtttcttgcaataataatcaatcaaaatgataaacactgtcagattaaaggattaatcatttcttttctacaaaattagagccgttaacaggaaatcgccacaaaaaaacgttatattaagggtggaaatggttctaatagaaatttgaaaatggggtaatttgatggacaactcagcatcaaacatcaatgttgatcaactgaccactgaagagaaaatgaaactgacttctggtaaggacttctgggcctccgaagcacttcctgatcataagattccgagtatccgaatgagtgatggaccccacggcttacgttaccaagccgctgctgctgaccatttagggattaatgacagtgtcccaagcacaagttttccaaccgcgagtgccagtgcggctacttgggatccggaattgattgccgcaatgggggcagcgattgggcttgaggctcagagtctgggagttgatgtcgtgttgggccctggggtaaacatgaaacgcaatccgttatgcgggcggaacttcgaatattttagcgaggatccatacttggccggcaagcttggtgcggcctggattcaaggcatgcagaagcaaggaatcgctgcctgtctcaaacattttgctgcaaataatcaggaaaacggtcgcttatcgtccgattcgatgattgatccggtggcacttcatgaagtttatttggaggccttccgcattgccgttactgaaggccatccagaatccgtcatgtgctcttataacaaagtaaacggtacttatacgagtgacaatcgctatttaatgacaaacgtgctgcgcgatcaatttgggtttgatggtgcggtcatcaccgattggggcgcgttgaacgacaaagtggctgcgcttaatgccggaacggatttagaaatgccaggtgatgatcatttatttgacgatgaggcgttgaaggcgttgcagtccggtgaattgcagccggccagtttggatcgtgcagcagctaatattatcaaaatggcgcgtaaacatcggcctagcttccatggtacgcgtgaagccttattacaccaaaatgctcagttagcacagaaaattgcggaaaatgccattgtgttactaaaaaacgacgaccacattttgccattgcagaccagtgaatcattagcggttgttggtgagatggctaagggaacccgctttcaaggtgcaggttcttcccatattcaagcagctgaacaagtgtcgattttgagcggaatcaaacaggctgggctcacttatgatttcgcagccgggtatcgacttgatgatgaagttgatcaggagaaaactgcccaagcgttggaattagcgcggacgcacgacaaggttatttttgttgccgggttgcccgataactatgaatcagaagggtttgaccggaagaacatggccctgccaaaagtacaaaacgacttgcttcaggccattgcagcgattaacccgcatgtcattgttttattggtcgccggagcaccggttgagatgccatggttagatcaggtacaggcaatcttgaatttatatttaggcggggagcatattggaacggcaaccgcacgggtactgaccggtcaagtcaaccccagtggcaagttagccgaaacctatcctaagcgctatcaagacgttgtgtcagctgagatttatgataaacacacgcgcgcggttccttatgtagaaagttcctatatcgggtatcgttacttcgataaggcaaaagtaccggtggcgtttccgtttggttttggtcttagttacaccacttttgcgatcaagcatgtgcggcttgtcaatgatgaagtaaccgatgcgcagccggtgacggttcaattagatgtgaccaatacaggggatatggacggggcagaagtgattcaggcttacgtcaaagaacagcagccgcgtccattacggccggaaaaagcgctaaaggcattcaagaaagtctttattaaagctggtgaaacagtcgcagttcagttggaattacccgcgcaagcatttaaagaatggcaggaaaagacccagacctgggtgcttcctgctgctgccaagtcggtagcaattggcacaagcgctgctgatattgtggcaacgttgcctgttcatttaaacggcaccaacgtcaccaatttcaaaaatgttcctgattggtataccacactatcgggcaaaccgactgtccatgattttgaacagttaaccggtcaaaaggtgccaccgcatcatgagtttgttccgggagaattcacgcgactcaatacaccgcgcgaaatgcaaaaacattcatggattgtccgtacggtaacccggatcacggttcgaatgcgaacaaaagactatcttgacaaagaaggcccggaagctaagtttcagcaagcaattgtgctagatacaccattaattcggctggcccagcaagcaagtggcattttaaagttaagcatggttgatcgattggtcgctgcagccaaccatcaatatctcaagatgatttttggataacaagtgtattgtaaaataattagaattttttcttgacgcggacaaatgctttccagtatgcttaatcccatacaaaaccgagggagtgttcaccgtgatgaattatcggcaaacacaactaaataacttttttggcagcttttttggatagcggtttgcactcggatgcaaaccgcgcaagcaacggtttgcatccatgaggctgtcacattgaatgtgccaacaaagccgtgtggatgaacaatcatccatgcggcttttcgatatcgaaaactcgggccagtcgcatggataaaatccaacggctggcccatttttttgtgagcgtgaaccggcgcggttaaggatcggagtgtaagtggccttgggcgtgatggccgggctttggccattgcgtccaaggtccttacacgcagatccttgcgccagcgaacgcgttaagattgagcgcgttacggctcgcttgctgagggctaactcgtctgacaataccggttaatcagacgcgtttacctaaaaagtgaccaaaaaaggtactcggttttggcttttgttaattaaaaaataacttggacggatacgtgatctgattgtctaacggcgctggatcgcgcaaattgggaggaattttaatgaaaaagcatctcgtactcacgatagcagcaactgtcttgattggattgaccttaattggttgcggtaagaaatcaagtgccgccagcagtcgaacggttaaagtcggtattttacagttaatggaccaaactgctttgaccgaagcgcgtaaagggtttgaatcagaacttgccaaggccggatacagtggcaaacggatcaaacttgattatgtgaacgcacaaggcgatcaagctaatctcaaaaccatgagtgaccggctggcgcgcgataagaatgatgttaacttggccattgccacaccagctgctcaagccttgcaaaaagccgataagaagacaccgttgcttttcacggcgattactgatcctaaatctgcaggactggtgacgaatttagaaaagcctgacaagaatgcgaccggggttacagatttagtcgcggtggcagatcagattaatttgctgcatcagactttcccgcaagccaaaacgattgggttaatgtacaacgccagcgaacccaattcggtttatcaaatcaaacatgctaaggcacggctcaaacagttagggttgcgctatcagattcgcaccgcagcaaccaccaatgatgtgcagcaggcagccgaaagtttagccaaggatgtcgacgccttgtatctaccggccgacaacgtgatggctgctgcaatgccgacgatcggtaaagttgccaaagctcaccagattccggtcgtcccggccgcatcaaccatggttaaagacggaggcaccatcaccaaaggcatcaactaccgcgatcttggcaaacaaactgcgaaaatggtgatcaaactgcttaagggaacagcagtcaaaaaactaagcgttgaaaaaccggccaaagttgaaaccgtaaaaaatgaagtgatgctaaaaaatattaagcaaacggtgcacctgccaaaatagccatgatatcaacattctttgacatttttcgatattctgaaatccgattagccaacctaccggcgaaaacttgtgttgacaaactgagattatgagtatacgctttgaaacaagccagaagggttaacttctgagcaaaggagtgttgatcatgagacaaagaaaaacaacacaacttaatcacgcgtactattacggctatttcggataatggtttgtatctcatggatacaagccaatcaggtttgtatccatgatggccgtgagtatttcacttgcaattaaccgccacatggacgaattcatccatgtggctttttctttcccgggaaaaaagtaaaaggccagtcacatggatgagaaaatccagtggctggccttttttggcgagtgagttctgtagtgcgagtgccagtgtgagtagaaggtgactcgcgctcaccataacgcgttcacagggccagaaacctgcgtgtaaggaccttggtcgcaatggccaagagcgggccatcacgcctgaggccacttacactccgacttctaaccgcgccggctcgcgctcactttattttaggaggaagaaaatgatgattaaaagaatgatgattaaaaaaatggctgcggttgtagcagcggcgttgacggttgtggctttggctggttgtggtaaatccacgagtgctgcggctgataagagtcaggtgaaggttggggttttgcaattgattgatcagcaagccttaaccgcagcacgaaaaggttttaccgaagagcttgctaaagccggttacaagggtaagaagatcaaacttgattatgtgaatgcccagggcgatcagtcgaatttgcagacgatgagccaacgcctgaagcgggacaagaacgatgttaacttagcaattgccactccggcagctcaggccttgcataaggaagatgctacaacgccaatgttgtttacagcggtgacggatcctaaggcggccgggctggtaagtaacccttctaagccagacaaaaatgcaacgggggtaacggataaagtcgatgttgcagggcaaatcagctttattcacaaagttttccctaaagccaagaaaatcgggttgctcttcaatgccgctgaagaaaattcccaggttcaagttaagcttgccaaggcagcgattaagaagttagggttgacggcagttgagaagaccgcggcaacgaccaatgatgttgaacaaagtgccacggccttgatgaagcaaagtgatgtcatctacattccaaccgacaacacgatggccgcatctatggccaccattggtaaggtcagcaccaaggaaaaagttccggttgtgccagccgatgccacgatggttaagttagccggagttgcaacggtcggcatcaattacgaggacctcggcaaacaaaccggtaagttggcagttaagcttttgaagggtaaacaggtcaaagatttggcagttgaaacaccagccaaaacccggttagtcaccaatcccaaacggatgcagcaatttgggctgactgaagcgatgttgaaacaagcagaataggcgagcatttttaaaaaggggtttcgttatggatattgtgacatcaagtattgcccaaggattattgtggtcggtcatggccattggcgtgtatctgacatttcgcattttagacattgccgatatgacggcagaaggtagctttccactaggcgcggcaataactgctcaggcaattgtatcaggagttggcccgattgcggcaacgttgctgggatttgccggtggggctgctgcaggtgcggtttcgggttttctgacgaccaaactgcacattccggatctgctcactggtattttgaccatgaccggtttatattccgtgaatcttttcatcatgggaaaagccaatgtcagcttgattggcgcggtcaagactgtgttcaatttgacagatagcggggatgcgacaacgaccggcatcatcgtgggcgctattgtggtggcaattgtcatcggagccctggttttcttcttccataccgaaatgggattggccgcagccgcagttggtaacaatcagaatatggcggctgctaacgggattaataatgacgcgatgaagatcattatttacatgttgagcaatggcttgattgcattgtctggcagtctcatggcacagactaatggctatgctgatctgtccatgggtattggcacgattgtaattgccttggccgctatcatcatttccgaaatcctggtgcgcggggtgccgttgtgggcgcgcttgctaatgatcattgtgggtgccgtgatttaccggctcattattgcggtggtcttggacatgggcgtggatccgaactacttgcgcttcttctacgcactcatgttgacgattttcttatcactgccgttattgaaaaagaaactctttcaggtaaaagtacgacatagcaatcggcaacaggtcaagtctgaccaacgcatggttgccaagacatcggatcatatgacgattgcaccggcagagcaacaaaaggaggttcattaacatggcagttctggacgtacgcgggttgcaccaatattttgagcaaggtaccgtcaatgagaatcacgctttaaaaggaatcaatttgagcctggaacgtggtgaatttgtcgctattattggtggtaatggtgcaggtaaatcaaccttgttaaacagcatcgccggaacattgccggttaatcaaggccaaatcctgatcaatggcaaagacgtcacttaccaaaatgttgcgaaacgggccaagctcattgcccgggttttccaagacccgcgctctggcactgcctctttattgacgattgaacaaaaccttgccttagcagaaaagcgtggcgaatggcgtaatttctgggcaggtggcgtcaagcgccgtgatcggcagcattttcaggagaaactggcgacattgggtttaggactagagaaacgtcttggcgcagaaatgggcttgctttccggaggccaacgtcaagcggtgactttgttaatggcaaccttgaagaagccggccttgttgctgctggatgaacatacggcggcgcttgatccccaaacgagtgcgaccgttatgaccttgacggatcaaatggtgcgcgctcaacagattaccactttgatgattacgcacaacatggcaagcgcgttgaaatacggtgaccgcttaatcatgttggatcacggggagatcgctgtcgatgtacgcggcgaggaaaagcgacatttgacagttgaagatttgttaacactgtttaaagaacgcagcgggcaggaatttgccgatgatgcggtcttgctgagctagtttcgaaaacttaaataaccggcatgcgatcatgattaaatgagcgcatgccggttatctttttgcctataaaatcgatttacttgcaatctagctgattttcacaaccgtccgcagtgcgggatgggtaaagtgcttgttcaaaacgcgcggcaagtcagagagactgaccgtttgataaggcaccggagctagtttggctaatgcggcccaggcagcttgacgtaaggctgttggcgcactcacagaatcaatccctagcaagctgatgttgcgcaaaatgaacggaaataccgtgagcggcagggaagcgcctgcagcattgccacatagcgcaaccgctccaccgtaccgcatactcggtaacaggctggtggtgaaactaccaccaagcggatcgatggcaaagtcaaattgttgacgcgccaatgccttgccttttggtaactcgttaagggctaaagtggcagttgctccgagcgcgcgaacctgttgttgctgatcaggcgtgcggacaagggccacgcggtttgaaaagccggcatttgccaataatcgcaaggcaatactgccaaccccgccagttgcaccaccaaccaaaatcaacggctgtcgtttaggtgtcattccggcgtgcatcaacgccgtgacacacaacgctgccgtcaacccggctgttccaaacgccatcgcagtttccagtgtgagatttttaggtaatggaagtgcccattgtgccggaacgcgggcatattcagcgtaaccgccgccttgactgacgcctaagccatgaccggttacaataatttgatcgccttttttaaactgcgcatcgtgactagcgacaacggttccgcttaagtcgatgcctaggatctgcggaaactgccgcacaacttggttttgtggttgataggccaatgcatctttgtaattaacgtctgaataagcaaccttgatcaaaagttcgccggcaggtaagtcatctgtcgtcatagtttgtaaggtagcttgttggccgtcgtggagcaatgcctgaaacggttgcactttatgaacctcctagtgagcgcgagccggcgcggttagaagccggagtgtaagtggcctcaggggtgatggcccggttttggccattgcgcctgaggtccttacacgcaggcttctgcgccggggagcgcgttatagtgagcatgagcaggtgaacgtgttatagcgcaattcgactcctaatctgacaaacggggcacggcaccatagcttgctcaagtattaactaaagcatagcagattcatcaataaatacaaaacaaccgttattccgcaccaccaatcaattccgattgttgccatgcggctaattcatcgcgatgctggcggcgtttgtaaccttccacgaccagcattggcaaccagatgaccgccaaaacaatgagccattgtccgagatttaacggtgccagccgaaagacctgttgaagcggggccacagtggctaacaacaagatcaaggtaatggtacccaacaagctgccggttaatatcggattgaccgtgaaggcagcgcgattaagtcgcccacgggttttgatcgggaaaatatccaacattgagccaatcgccagcgtcaaaaagagcatcgtcatgccgacaattggttgattggcgctcaagccaaagcgaccgagtgcgtaaacgccgaggattaggccaacgtaagtcgttgtccgcaccgctactcgtttgccaagcccactggtaaaaatgctggcttttttaggaatcggtttaagccgcatgatgccaggttcggctagttcacggctcaagaagaagccgggaatgccgtcagcgagcacgttgacgattaatagctgttccggcgtcatgatcgcaccccaaccaactaaaactgcgatcagcatggtgaaaatctgcgcgaaattgacggaaatcagaaattcaacggccttgaggatattttgataaacagttcgtccttgtgccaccgcatcgataattgtcgcaaagttgtcatcggtgagcaccatatcggcggcgtttttggccacgtccgttccggtgatgcccatagcaatgccagcatcggcggcttttagcgcgggggcatcgtttacgccatcgccggtcatggccacgacggcttgttgctgctgccatgctttgacgattctgattttatcggtcggagtggttcgggcgaaaacgcgaatttgcagaatatcggcggccaatgcttcatcactcatttgactcagatcgtgcccggtgatagcgcgttgaccgtggtcgaggatgccgatgtcttttgcgatggcagtggcagtgacaagatggtcgccggtgatcatcacggtaataatgcccgcatcttttgcggcttgaatcgcagccggcacttctggacgcggcggatcaattaagccaatcagtcctgaaggttgcacggcggttaattgcgtctcccagtcggcaccggggtcgttttcgaattgctggtaacctgctgccaagacccgcaatgcctgcgcagtcatctgatcatgaatcgctgtagcttcctcgtgccaatgatcattggaaaaggcaatccgatcagcagcgcctttgatgatagccagaaaatggccatcgggagttttgtgcaaggtcgccatggtctttttatcggatgaaaatggtgactcggcaattcgtggatagcgggtttcaagatcatcgcggtttaagccgtagtgggccagcagccgaacaattgccagctcggtggcatcaccgatatccggttcgccttgtttggtgagccgggcgttagttgccagccctaaataagtcaaaaattgctgctgattcgttgataagggttgatcggtcactttttggagtgcttcacgaaacggccaaaaatgggtcacggtcatttggttttgcgtcaatgtgccggttttgtcggaagctataacgttgacgttcccgatggtttcaaccgcggtgacttgtcgaataatagcgtggcgtttggccattttctggacgccgtgtgccaagctgagtgtgacgatgaccggcaatgtttccggaaccgccgcaatggcaagactcacaccgagcataagactttcggttaaggtttcttggtggtaaagcatggacaacagcatcgtcagcgcaccgcctaagatggccactaacgataagcgtttgcccagtgcgtttaggcgtttggctaatggtgtcgcttgtttttgcgtttgattcaataatgatgcaatttttcccaactcggtctgcataccggtggcggtgacaatagcgctggcttttccactggtaattgccgtaccggaaaaaaggcgattaacggcatcgccaagatcatccggcacttcagtcagtggcgcggcagatttggcaacggcggaactttctcctgtcaaaactgcttcatcggtttcgagatcctgactgtgaattagccgcgcatctgccgctactgcatcacctgctttgaggagcatcaaatcaccgcggaccaaatctgctgcggcaatggtttgggtcttaccttcacgaacaacggtgactgtttgaaccgtcatggcttttaaagctgccaatgctttttcggcactgtgttcttggtataaggcgatggcgacgttaaggatcacaatgctgccgataacaattgttttggtccagtcactgtcagtcgtcagggctagataagcagatagtgcaacggcaaatagtaaaattaacgaggtaatgtcgctaaggtgatgcccgatttgccgccataaactgggctttttggcagcagtcagttggttggggccatcttcttggcggcgtttggcagctgcgtttgtcgttaaaccggttgtgaggtcggtgtcaaaatcagcggccaaatcgctcggcgtcaaaagcgtcaggtctttggtcgttggtgttggcatatgctcaatcctttctggggtcgagttgtcttcgtacttacttttaataaccgtaacataatgatgcggtgcctgtaaaatcttgtgctgaagtgcgtagttgttcgacctcaccataacgcgttttccggcgcagaaatctgcgtgtaagtacccttggcgcaatggtcaaagtgcgaccatcacgcccaagaccacttacactccgattgataagcgctcctgttcgcgctcaaaaaaatggactgctttgtgttattagcagtccattttggtacagatatcaaatcttagttaccgttaattttgcaaggcgtggtagcggtaattttgttgttgggtcgtttgcgttttaaagccataagtgtcagctacaatgtagagcggtcggtgtcggctttgggcaaacattcggccgatgtagttgccaagtagaccgatgctgaaggtgatgccggcaccaacaagtaacgttgtcgcgatcacccaagttaataagctgagatgacctaaaaagaaactgatgccgacaatagccacggccagtagtagaaagaagccgctaagccagttggcaattgttaaaggaacggtggagaagctggtaatgccgttcatggcaaggtgtagcattttctttaatggataatgggtttctccggcggttcgtttttgccgatcatattctacggcaatttgcctatatccaacccaggccaccataccgcgcacgtaaggatcatgttcattcatttgttttaaaacgttcacgacgctgcgatccattaagcgaaaatcacctgtatcgacggggatgtcaacacttgtgagcgcctttagcacgcgataaaaagtttcggcagttaccttcttgaaccaagtctcgccgctgcgtttgcgtcgtttgccatagacaacatcatagccttcttgccagcgggcgatcatggctgggatgacgcttggcggatcttgtaaatcagcgtccatgacgacaacggcatcaccgcttgcgtaacgaatgccagcggtaatggcaagttgatgcccaaagttgcgcgagaagtctacgaggcgaatggttgggtttttagccatcgcggccttaatctgggtggcactgtcatcggttgagccatcattgacaaagataagttcataccgttctggtcgcgcccggacatagttggcgagttcggttaacgtttcgccaatgcctgcgctttcgttgtaaacgggtaagacaacggaaatgaagggatttgttttttgtcgcatcacgcttgctcctttctgaattaatgaaaattacttcaccatgctggcatcaagttcatacagcgtgccgctgcccatgctgcccatgccgcccattgccatacgaccaccttgattgctttgggcgttggtggttgtcttgctgccgtatttgcttgcggccacctttttgccgactttttcgacccacgcttcaatctttgaattgccggagcgacccgatgacaggtaatatttcatgtcgccacttttgaccagtgctttgaattgcttcaacgtaattgccggatcagtgccgttaaatccaccgattgccataaccgctttaccggatttgataatatacggggcggcagtgctagcgttactggtagcaaaaaggtatttggcattgccttgatgagcttcaacgtacttcaataaaccgctattgacactgccactaccgataccaccgctattaccgcctgacgttagcaaagtagggccagcggttggaatgcctgatgacgaaccggcaagtgtcggtgtcaacgaccagaaacctggtgcggctaagatagcggcaatcgccacgcccagcgccgatttccgccaggttttggttcgggcgatgaagagcagcgccaaaccgattacaccggcaatgactacaagaatcggttgccactgatagtaaagactgacataccaagtctgaagtgcagtcgttgcggcaagtgcaagcgggagcagccaactctgccagtgcctgaagcttaatctgaactggttaaacatggtgactgtgccgataccgaatagtgccgcgagtggtggcgcaagcataatcgtgtaataagggtggaaaaaactggcgattgaaaagaagcctgcgactggcacaagccaacccagccagaaaagcaagtgattttgctgacttgtggtttggtaccatttgcgttttcgatcaaggtaataagcaaaggcactgataaagccaatgatagccatcggtgcaagccagcttatttgtggaccaagatcagattgcagcaggcgcagtggcccggcattcccaattgaaaaggcgccaccgccgcgaccgccagctgcaccaccaccggtaccacggccgcctttaaagttgccctctgcaaagtttgcaggggcgttatttgtagatgtgccggatttggtcttcacagtaggttgtttaccgttagttccggctggcggcgtgccgccctgaccttgaccattacccgggcgaccaccaccatttccgccaggtggcgtaccggttgtgccctttgtgccggttggtggatttcctttagtgccagtcggtgccgtgccggttttgctattgttgcctttggtcgccccagatgtcgggttcatttcaccagtcgctttggtcttgctgttgcccataccggggaaagccgcaccggtaccggttgtttggcccaataatcgttcagtaccgttatagccaaaagccagctccatttctgaattcgtttgggaactgccgacatagggccgctggctggcggcggttgagtccacctgtagtggccaggcaagtgtcatgacagccatcgcggctaatgcaatccccagtgtagccagtcggcgccatagctgctgctttgatgcaagccagaaaaagagtaataaggctggcaaaatcatgaacgcttggagcattttaatgttgaacgagacaccgatcaaagcaaagctcatgatgaccagccagggcttgcggttggtgattgctttcatcaggcaccagctggcgagcagcagaaagaactgtagtgtggcgtccatgttatttgttcgggaatccgcgacaacgataggcgttaaggtaagtgccaatgcagctaagcgggcggcccaaacattaaagcggggtttgatcatgttatagattagcgccacgctgccgatgccaaacaaaattgagggtaaaacaactgaccagccgtgaacgccgaaaattttggcggaaatggccatgaaccaaagcgctaccggtggtttatcaacggtgataaagccagcgggatcaaatgcgccgtaccagaaattgtgccaactttggatcatactggtgatagcagccgtgtaataatcattagcgtttcctgcttcccagatattccagctgtaaagaaacgcagccagaacgagaatgccaatgagccaccaatcaagggtccactgtttaatttttttcatgtgccgtaactcccttttctcgaaatacccagaacttacttaaaaggaagttcgttgggacggtaatcataagtgcaaacatcggtgctaatggttttggtaaattcaatgcatcattccagaagcttgtgagtatcaggctcatgataaaggtgagaccatacgaaaaatagtatcgtggtgccacacttttaaggtcgcggtgatctttaaccttaaagacccaggtatcattgaggaaaagtcctaaaactgacgttaatccatagccgacacccatcgcagcggttggattgatcaattggtataatgtcaggtaaagcaagtatgtcaaaatagtattgataccaccgactaaaccgaagccaatgaattgtttcagcttttggcgcatcgaatcgctcccttcttgatgaatgggattagtatgcgagatgcagcataaattaaccttaaagccagcaatttttttcttaagctgagtttatgattttcatgttaagctgacgctgtgattgataagactgaaacattggctttggtggggatggtggttggcggctggtggttaggcccctatgcgcgccggctcacgctcaccataacgcgttcgccggcgcagaagtctgcgtgtaaggacctcgaacgcaatggccaaagcccggccatcacgtccgaggccgcttacactccggcttctaaccgcgccggctcacgctcagctcaccataacgcgctccccggcgcagaaacctgcgtgtaaggacctcaggcgcaatggccaagagcgggccatcacgcctgaggccacttacattccgatttctaagcgcgccggctcacgctcagctcaccataacgcgttcgccggcgcaggggcctacatgtaaggaccttgggcgcaatggccaaagcccggccattacgcccaaggccacttacactccggtttctaagcgcgccggctcacgctcacttttagaggagaatttatgatagttaaacctaaaattcttgtaattgaagacgatcctgatctgaatgagagtattgttgattttattcgggacttttctcagcctgaagctgctttgacgggtgctgatggtttgtatttggcagaagaggggatttttgatgctattgtgctggatatcatgctgccagagctgaatgggtttgatttgcttaaacagctgcgagctaagcaagtgaagaccccggttcttattttgacggctaaagatgccctgacagataaggtgcgtggttttgagttgggtggtgacgattaccttaccaagccattccaccgtgaagagctcattatgcggttaaaagcattgttaaagcggacaggacatttttttgatgaggatgggttaacagccggtccgtttgaagtccacctaaaccggcacgaagtcttaattcacgacaaaccagtagcgttgaatggaaaagaattcgacttgttagtgtacttattacagaatcaaaaaaccattattacgaaggatcagatttttgatcggttgtggggatttgattcggatacggctgtcagtgtcgtcgaagtttatatgtcgaacctgcgcaaaaagttaaaaccgatgcaagccgatgtatggatcaaaacaattcgcaatgtcggttacatctttcaggaaccggaggaccgtgcatgaatgcagataaaggcattaagcgacaacagcgacgtttatttatcggtcaactactgagctttgccggactttttctagtgttgggggtcattgtttttttcctttatgaacgttcgatttatcaagatatcgatcattcgctggaacaacaaaaaataatgcttaccaagccggcacaaaccatgagcggtgcaggtggtcccggacgcccggtgacttcacgaccagtaccttttcggatgaacatggtggtttttaataaaaaaggaaaaatcatcaatcaggcgatgttaggtgaacggttttatgcctatttcaaaacgttaaaactagatcgtcaggcagttaataagttgcaaaatttgccgacttcaaatggcacctttagaactttactggtgaaggttccggtgacggccgcagatcctcaatatgccgggcattatgtgttgatcttgcaaaatacggacgctcaagaagccgcgattcgttcttttcgtcaggttctgattttgacgattatcctattttgggcgttggcactgggcttgtcttattggttatcaacccgttcaatgcgtccgattgttcggtcatggcagcggcagcaggattttgtggcagacgcagcgcatgaactacgagcaccgctggctgtgattcaaagtaaacaggaagccttgctaaccaagccacaagccaccattattgacgaaagcgaggccattgcgacgtcactgggcgagaccaaacgcttgcggcaactcacggatgatttattgacaattgccaaggccgatagcaacacgattgaaatcgaattgatcgatctgcggtttgatcaaacactggccccgcaactggcttcttatcacgacatttcgattagtcaggataaatcgtttaccaccacgattccgccaaaaagccatgcctggtttgacgctgcacggattaaacagttactggttatcttactggacaatgcatttaaatatacgcaagccggcgattccatctgggtgaaggtcacccaaacctcaaaagagtggcaactggtggtgggcaactccggaccaagcattgttgacgcggataaatcacgtatctttgagcgtttctatcgcgaagatgcatcccgcagccgaaaaaccggtggcagcggtctgggactagccattgcccgctggattgtgaccatccatcatggccatatcgaagtaaaagatgtccatccgcatggtgccgcttttgttgtgaccttgccaaacaaaccgcgtggcatttaaaaattaaatacgaaaaatagccgttctccaaactcataggcttggaggcggctattttcatggttgaaaaattaagggtgaagcagcagtgtgaagctttggttgcggatcgtcggacaagccaagttacccgttttagcttttaacgggccggattattgcggacaccattggcttgtgtgaaatcaatgaagcccatgttggtatcaatgtcgccaccatcaccacttaaaaccaaagtatttaaggtcgagttgaaatggacatgcatattggcatttaagtcttcctgcgaataacccttgatcaaaattggtccaagattactgctgatctcagtgtcatagtcggttgctgggtcactagccttgacgacattaagtgagaattgaacttgcatatgaatcatcgcgtgctgcgaatacggtccaacaccatcttcaaacgtcaaaagcaacttcttgtccgaacccaaatgcggttggatcttgttcacagctccttcgtcaaaatggatttgcatcagatcaacccctttcgacgccaatgtaggctgattaagcagtaaaagcaacttttttgactcactggtaattggaaaacagctactggttatttgtggtggaggctaagttggcgatgatccagatatcggcggactttaaaactggcgccaagtttgaagcaagtttcagcatctttcaaatcgaggccggttaactcgctaatatgattgagtcgatagcgcagggtattgaagtgaatgtaaagtcgtttagccgtgtgcgtgaggttttcgcctgcttccaaatacgcatcaagcgttggtagaagttcggttttattcgtttgatcataaaccatgagcttttttacggcggggttaatgaagaacggcagaatttcgacgtgatcaacctgagccaacattaaatcaaaaaaagcatcttcgcaaaaaataaccggattgcgaggtaatttaagcttggccgttcgtttgcaaacagcataagcagcgatggtatcctctggccgatcgtattggttcgagacaattaagcggcaatcggtccgggcagcaatcgttgccagatgttctttgaacgactggctgttgtattcaggtaaatcaagcgaaacaagcgctaaacattgatgatggtagatagtcaccaaagtttgggcaaagaacggtgtagaaaaatattttaatcgttctcttaaagctgctagtgattgattcgtgcaaggttcggccttgattaaggccatgcttgacgggaggatggctttttgtcgcgcaaattgagcggcaaaggtttcggtttgctgttcggtcagcaacattgtgagtaaatggtcacgttttgaggctgcagttgggatgattcgattcttgactaatgagcgtgtgataattggtgcgacagcggcgaactgagtatattgccgcgcattcagtggcgtttgcatggtcggcatgacgagatatcccaatgcgtcattgtgataactcggtggtaagtataaaagtggcaattgactagccgataagctgatttgtggtcgcttcgggatcgtaaaatgatctggaggtgccgatttgcttgctgtcagcccattatccaattgcaaatattgttggaatgactggtgatcttcaacttttaaagtcgtcactaccggatgaccgaccaaatcgacaactgccagcggattgccaagtatgcgcgcactttgtttaagaactgtatcaaagtcatccgtgatcgctttgagagccaagtgattcgtttgttcctggagatcggttttggtggttaaaagacacccgatgcgttcaaaaagtagcggtaattcttttggggatgagtgcggtagttggatcgaagttgccggtgttgttcgtgaagacggcatgattagctgaagaggctgattggcttccaccttaacctcaaacgtcatggctggcacctgatttgtccgcagagcacctagctgcatattgatgatatcgggattgatgttggcaggcaccgagccagtcggcattgtttgatttagacgatgcagaagtgttgtcaatttcataatagccaccttcagcgtaaataacggaattttgatgcttggcaaaaaccaccaaaagtatttgctcaattatgtgcaaatactatattcatgatacgttttgaaagcgctatcgtaaaggcgtattcggaagtatgaatgttcatatgccgtttaagccaacgtctttaacggctttagcagcagagtgaaggaggaaatcaagcatgaaagattttaaggggaaagtcatgatcattaccggagcggctcacggctttggtcgggttattgccgaagaaggggcaaaacgcgggatgaagttggccttgattgatattgatcaggcggccttgaatgaaacctatcagctggtggtggctcgaggcgctgacgctatcatgattccggcagatgtcacgaaagaatcagcagtcaacacggcaattgatcaaacgttgcgtacttttaagcagattgatttgttaattaatgatgccggaatagctttgcctggcagaatgtgggaactgccgacgcgtgattgggagtggatcttacacgttaacgtgatgagccaggtctatatgatgaaacgcattattcctattatgatggcgcaaaagacgcatggagcgattctcaatgttgcgtcaatcgccggtttagtcgacacaccgggaatgcctgcgtatcatgcaagcaagtttgccagtgtcggtcttacggaagcaaccgcctacgatctgcaacgtgccggagccgatattgagatgcacgtgatgtgtccaggatttgtgcaaactgatctttatcacactgaaaagcatcgtcccgttcaataccaggattcaagtgacccatattatcaaagtgaagcatttttaaaaggccagcagtttgctaaatatgtgattaccaacggcatgccgattgatactattgccgcaactgttttcaaagcgctcgaagacgatcagttttatatcctgacgcatccggaattcaatccgctgattcttgatcggattaatcgaattgtaaaaaacggcgcgccggatgttcacgtgatggacggaattatgtaaaggtatcagccaacactgacgcataaaaggagtgatcagcatgtctagttatgttgtagcgcaaaaagatgttgaaaaatttttgaatttaccgagtatgaatgaccaggaagggattagttttgcctatgctaccgatccggacgctttggccaagttgattccagcgccgttgaagttagtcgcaccgattatttgcggctatgttgtccacatggggcggcccagttttggcgcaccgtatttggagcagaccttatttgcccttgtcagttataaagataagctggtgggctcatatcccttgacgctgttgctgcacggtcccggtgccgaagcaggtttagttgctgggcgagaaggggcaagcatccctaaaaagttagccgatcgcatcacccttcgccgcaatgaccaaacagcaacggcaacagtggcgcgtcacggtaaaactttgctgactgttgcttgggaagcaggggatgtcaatgatcccgagattttaaaaacatttggtagtcaatttgcgctgaatcaggaatcaatcatgaacagtttcttcttcgactatcagcttgtccaagatgagcaaggagccaatcatttttccaatgttgcgttgctggcgactcagatgaaatcactagccgaccgagttgaaccgggaaaattgaccatcaaactcgactcaaccgaggatgatccgtttggagagttacctgttctcaaaccacttggggcaatgtggtaccattttgccacttcaacaatgtttaagacactgaggttggaagaagttaatgccaataagacggcaccgtatctgattacaggtcgttatgaccgcagtatgatgaatccattcgcaacaacctatactatctgaatgaaaacggttaacatattaattaagaaatgaggtaatttaaaatgacagaaacagtagcgccaaataaattaactaataacgatttagcaaaggtgatgttcgatcggcattcggttcgcaagttcgatccaacggtaaaaatcagccgcgatgagctgcaagatatgattcgggaggcaacaaccgcgccgtccgcttgcaatttgcagtcgtggcattttgtcatcattgacacccctgaaggcaaagagaagttgaaaaaagcggccatgaaattcaactatccgcaaattgataccagttccgccattattttcgttgccggcgatacccaatcacatgaggtctatcgcgatgtgtggacgaaggtttacgaggcaggcaaaatcagtaaagagaagctggaccaaatcttcaacaccttcctaccactgtacgaacatgcctcacctgaatttctgactttagatgcgaccattgacggcgctatggttgccatgcaattgttgcttctagcccgagcacacggatatgacgccaatccatggtccgggtatgactttaaaacgatcatcccaacattaggcctggatcctaaacgctttgtaccggtcatggcagttgccatcggaaaagccgccgaacagccattacaaacagagcgctatgacgtcaagcaactgattgattacctagattaaccgagtcacattaactgcaaagaagaaaggaaaccaatcatggtagatgcagtgaaaaccgatccattcggcaaagttaacgcaattgatgtgttagatttagcaagtttagaagcgcgcgctgaaaaagtccttggtcgcggtgaattcgggtacatcagtgagggctctgacgatggctacaccatgcaccgcaatacaacggcatttcaagacgtgcacatgctgccacgtgtgttacaaggcgttgaaaatccggatcagtcaacaacatttatgggcgcaaaacttgcttcaccgctgctaaccgctcccattgccggcaacactttagcccacccaagcggtgaactcggtttagcaaaaggcgccaaagaagccggtatcatgatggcccaaagcacctttgcctccaaaaccatcgcggaaaccgcagcggtcagcgatggtgcgccatacatgtttcagttatatatgcctaaagactgggaatattgtaaatacttgctagacgaagcgaaacaggccggtgcactggccatcattttgacagcagattcaacattaggcggttatcgtgaaaaagacgtgatgaatcattaccatctcaaaggccgacttgccaacctcgaaggctataacacagggcaatccggggttggcgcaggcggtttgtttaaagaatccatgcaaaagctggatcttggcctgatcagtaaattagccagttattcaggcttgccgattattatcaaaggcatccaacaccctgctgatgccgttgctgccattacagcaggtgctgcgggaatttacgtctccaatcatggcggccgccaactcgacggggcaccaggcgccattgaacagttacccgccatcgccgccgctgtggatcatcgcgttcccatcatctttgacggcggtgttcagcgcggcacccatgtactcaaagcgctggcactaggcgctgatctcgttggcattggtcgaccatttagttatgggttagcacttggcggctggcaaggcgtcaaagatgttgccgatcatctgaaaatggaaatcaacatcgccatgcagctgaccggctgccagacgatggcggatgtgaagcagatgagggtgaagacgagcttcaattaggtttactggtctagagtgtttagcttaaagctttaatgagccgaaatgttcctagagaaaagaatatcaaagaagcgccaatcacgatgaggagtacctcaaaagtgattgacgctttttctggatcttaacggacttgaaccgtcgacctcctgcatgccatgcaggcgctctcccaactgagctaaagacccgccatgcaacttggtactaatggatccaaacggacttgaaccgtcgacctcctacatgcgaagcaggcgctctcccaactgagctatggacccaaaacacaaatctaattgtactgaacttcgacgttggtgtaaaggggattgaccgtaattgggcaaggatgtttgacgttacgcaagggaaataatagtggaaaccatgcttatcttggaaagcacatacgaggcacttgcagaaaaggcggccatacgattgattttaaaatgatagcgcccaactttagaaaggttccatcaagcttatcttgattcagctcgccgggtgataagggcaatgaagacgttttggagcacaccaccgacaacgaagatgagccaagaatagctccaggtatcaaaaaggattgaggccaagaagtaggtgacaagaatcagtggccaataaacttgccggaaaagtgcaatgtcttgacgtgcacgctggttatggtggtgttttgctgcggaccaactgcttgtgtgttcgtcatggggtttcggagctgaatttgggactgttgtggcgtaggtgtaacgtttcagttgcgaataattaatggaaacataaagaataagataagtacctaatcctgcgataatgagaaacagcgcgccacctgcgtcatcgctgataaaatggctaatgtattcagagaggatggcagggatgagcgagcagatgcaaatcatgatgccaacgatcaggcccgcagcgaattgccgactataggccgccgtttcttgttgggcaaggtgcttggcgcttttggtgattgttcggtcattgggtaactttttttgctggctgtaagtggtgcctgcccaaatgaagagaccgactgcgatggcatctagtaggaacatgccgatgaccccgaacacttcataacgagaggtgccggcataagcaggtaaggcgacgctgatgcagcatagcaatacgccaagcgcgatttgtgtggcaaaatggtcaacgctttgccaaaaatgccgcagttctgattcggtaatggcatcatcgtcggccgccgtttcagcacggttgggatcggattgcaccggaaggcccagatcagcgcgcaactcgtctaaggaaccaaatgcactgatcacagcaccgatggctgcttcttcacttttaccgtcccgtagcaaatcgcgataatagtcgcgcatgttggcgagcatgtcggtttttgcctgttgggttttggcattatcgggtagtgaggcgaatagactatctaagtaggttttaatcgtatccatgggcaggttcctccaaaggctaaagatcggttaacggctgattcaggaataaatcgacaacggttttgacacggcgccattctgcggctttaactgcgagaaaggtttgaccgcttgtggtgatgcgatagtaagttcgcggttttccatttgtgacggcaccggggtaagcttcgatatagccatttttacttaaacggttgaaggcggcgtaaagggtggtctcgcgaatgatgtattgtcccgcggttcgctcgcgaatttctttgccaattttgtaaccgtacgaatcgccttgatgcaaaatggcgagaataaggacgtcattatagccacgcatggcatcactactgatcacgagcgcgcctcctttgtgcagggttggttggtgcagcggtggccgtgaactaactggcaaaggtgccattcgttgactactgcatctgatgaagtaatactaacacgattacttcatcaggtaaagtaaaaaaacaccttcaatcatgaaggtgtttgctgatagtcgattaatgtacaaaaacagtaacgaatgtaaccagcccaaacagaatacctggcatattagagataatgattggccaatctttgtaagtttttaaccagccatagcaagtccataaggtagcgttaaccattgctactaatggttgaattggattgactggatttccagaaaagtttgcaatgatttccggaatgtacgaaacatacattaaaatacaggtgaaagttgccagcttactgaggagtttgagccgctttattcgggcggggtcaacaccatcaggatatttcccagtatcaacgcgcatctaaaatgcccccttttaggataaaaataactttaacacgattggtcttaaatgccaagtcgaggtgatggctgtgatagaatcgaataggcggccagcatcgcgttggtcaatttttattttttctgaaaaagcacgaaatgagggaactttatggcagacaaagagacagatatggtcactcggattcagaagcaggaaggtgccgatgcgatcatggataaggggtttgtgaccgaacgggatatccctgaaatgatggataagacatggagtgagaagttgttagatgccattaatgatgaattgcgcctacgcacagttataaatcgagcagtgatgcaacaatttcattattatatgggtgatggaacgattatctatgatcccggccagctgaattcagaaggggcaaagattgcattgcagcatgctttaggtttccggaaataaaaccttgatcttaaagcaactggaggcatcatttacagagaaaaggtcccagtcaaaacgactttaccgaccatatgcccttcttctactaattgagtggcagcttttaagtttgctacattaatgctggtgaattctttggttaccgaagcctttatttgtccgtcttgatacagggttagaagtttgctgaggatcgcgccttgagaagcaatgcggtacgaaaaatcggttttggcaaacatatactcgtaatcaaaactggctgctttatctttgacgactgccaaatcaagcccggcttgcggaccgacaatgcacccaatatggccaaatgcctgaattaactgactggcagcagctagatacggttcgggatgatagaggattgcaataccatcaacggtttgaatgccggcttgatggatttgggcgatcagatcctggtggtaatcgagcggcacatcaacgtgatggtcgcgcagccatggatgatttttgggactactcgtggctaaaacggttaagccgctccaatgggctaactgactgagcatggaaccgacaccgccagcgccattgataatcagtaattgttgacctttattcgcattgtattcagggatgaagcccattttttcaaatagcaactcccaagccgtcaatccgaccagtggcagtgctgccaagtcagcagtgggggcttgttgtggtgcgagggcaactagtcgtgcgtcaactgcctgatattgctgattactgccgggtttgcaggtggtgccagcgtaaatgacccgatcgccaacatgataaccagcaacctgtgcgccaacttgggtgatggttccaactgcatcatatcccagcacttgtggcgttgcttgtcgcgttgccgcttgccgacgtttggtgtcaatcggattgaccgatacgccgtcaacctgtacaacgacttcatttggttggggagtcgggacagggagggcaaagctttggaagctgttttcggcagtgatcggtaagccttcagtaaaaccgatcgcaatattttgtgacatttgaatcgtcctttcgtttaatctgtcgttattgtaacctttttatgaagtgagttggaaatgcacaggttatttggtaaaatgtgcaggatattggcgaaacaagccaagtgtgcgcaacccagctcgaaaaattcgatgccgattgacgaatcataaaaaattaacgatgaacatgacgtgaagacgatagctttaaggaggctgctcgtgaaaaaatttggatcaaaacgtgaattgataggcctggtcattgtcttagtactggcagcggcggggtttgcatttttcgcgtggtacacgatgcgaccggctgatacgatcgggacaattgcgacaattagttttggcattgtattatccgccttgattggtatcgtcttattgttagatgctgcagccaggactcggtggcgacgtttctggattgatcttttgttcgccgggttaatgctggcgctgattgattattacttcctggatgtcaccgcgccgtggcagatgctggtgacgggtgctggcctggccgtggtattggttgcgctcctggctattcgaaagatcgatgaatagtgttaatgacgactagcaaaaaagctctccgaagaattcattcggggagcttttttgcttttacgtatgcgtgctagttcatacgctggacggttacaggaaccgtttttggcagtacttttgacagttcggttaacaggttttgaagactggcctgaaacgtcaggcggaccatccgccgtttgctaagggcaaatacggcaacaacccattcttggccatttggaaggcttaccggtgtcaaggtgatactggacatgtgcgtgtatggaatcacgcgcgccagtaaaccgttggcgatcaggcgagtaggggccagtccgccagtccctgccataatggataacaccaaaaagatcgagatgaaaataatatacggcatgttgttaactctggttgtcataaaccaaaagccaagcagcacggcccagataagctgagacactgcatatcgggaagtaaattgaatcttactttgccaaaaaagatagtagccagctaggccaattaaaacgatgtccagtccgatcaataacacattaaaactattcatgaggtactcctttttggtcaacttcatctgtggggtgatctgattcgtacaaaccagaaacctgctgataccagctaaagaatcgcgtgacgacaattttcaaaacggcaaaacctgggatgccgagaatgaccccgaccaagccaaagagattgccggctgtgagcaggacaaccacgatggtaatgggatgaagttcaagtttgctgcccataaccagcggcgaaatcagttgcgtttcgatcaaccattcaataaagaagacgacaatcacggcgagaatcatgcgtggagaagtcaacgcgcccatgattagcggtgggatcatcgcaagggccgagccgaaataaggaatcagattcaacgggcaagccaacaagccgaaaatcaaaccataacgcaacccgataaccgaatagccgatcatgaacatcaccgcaacgcataatgcaaccgtgatctgaccttgcacgtatgaaccgactttttcattcatttcatggagcatttgcttaaccgagcggcgcagttttgttggcacaatctgcaagatcatcggcgtgaacttatcgccatcttttagcataaagaagaggatgatgggcgcagtggaaattgtgacgaccacattgccgacaatgccaatcagattctgcagctgtgaaatggtaccagtcacaaaggcaccttgtttacccgtgaagaaagtctggacttcattggcaatttcgttgagatcatgttgcgacaggatgttctgtttgtcatttaaatcgtctaaccatttgccgatttcggtaaatatttgcggcgcggaatcaacgatactggtgatttgattgctgacagcagggataaaccgtaataagccccagaccagcaggctaatcaaaacaatgaacagcaatccgattgccaagccccgatgcaacccggctttttcaaggcggttgataatcggaacggtgagatagaagagaatgccggcaaaaataaatggcggcgcaataatccctagaaaatcaacgactggttgaaagacccaagcaattttggtaaagacaaaaatgactagcagggccaaaagcaaatcaactagcagaatcatgaacttactattaacaaagcggcgatagagccacgagtcggtacgtttcaaaggcgatcctcctctaataacggtaaaggttatattccggtcacagcacgccaaagcggtcagacagtcacaaaagcccttacaaaacaaacgtagggctggcaagttaaccttgtcagtaaccgacagctgaagccgtcactttagcgctgattttaagcacaaaaatcaagtacaccttgtataacaatgatactcgactgagtagcatttttcgaggatgggttccgtgaaatgtcaagaacgtgtaattgcagtcgttacataaaatttacaaaaacacgctgaaatcgttacaaatattataaaagcctaaacaaaggcacttaatgtaaattttacatatacaaaagctttacaaatcaaaaaaatcaggtatgataaagtcacaaccaaaacggtgagtcaatgtcggttcatccgatacggagaggagtgaccccatatgagcatacttcggggcgctaaatggacattaataactctgaccctggtcgcaacgttgctattgtttagcaactatgcgacggccggcatcttgttgatggctctagatattttcttaagcttcttctatgcagtcatcaagagcagatgtgatcggcgtcagatgcataagatgccattattgcataattaattgatgaaacgagaggctgagtcataattcacagcttcaaaatagaagcgtactatttcaggtttttacaagaaatagtacgcttttttgcttttccgtattagtataaatgagctttaacgattccagtgccaaagcggagcagtcgtaggtcggatggggctcagccgtggaacaacacagcgaccgggctttgtcgctgatgttgttaggcgacttggagactgccggtcttgcaggctccaagcgccgtctccgctctagcttcgcgtcgccaccccatccggccggagactgcggagtttggcacggcccagaactactttatttactttctcagctatagtattcggattttagtgggcatcacatcctgagatcgaattatgtcttagattgttttgtgagcgcgagccggcgcggtaagggaccgaagtgtaagcgggcttcggcgtaatgccggtctttggccattgcgaccaaggtccttacccgcacgtctctgcgctggggagcgcggtccatacacagataaaaagtgttaatggtcttaatattgagacaaaaaagatattttgttgcgcctaacgacagttttttcaaatgaaacagcaaaaacaattgcaaacgtccgttcgtattggtatgctgagtgtaacaaaagagaacgaggcggtgagcggatgccaacacaagcaagtcagaaacgttggaaacagattttacaaacaatctatgaagcgatcgaggatcatgggtacccgcccacggttcgcgaaatcggtaaatcagtcggactcagctcttccagtacggtcgcggcttacttggagaagttgctggcggctggcttgattgccaaagatccgtctaaaccgcggaccattgaagtcacggcagcagggcttgattttattggggttcaggcacaaggaatcccgattgtcggaacggttgccgcaggggttcccattacggcgattgaaaatattgatgattattttcctgtccctgacgatcttccgtattccgccgatgaattgtttatgcttcgggtccaaggcagttcgatgattaagatcggcattttagacggcgatcagattattgtcaagaaacaaaatgatgccgaaaatggccagattgtcgttgcgatgaccgaagaggatgaggcaacggttaaacgcttttacaaagaaaagcatggcgttcgtctgcatccggaaaatgatgatatggatgatatgtacttcccaagtgtcacgattctcggaattgtcgttagtttatatcggccggcgcttgtgtaatcagctcataattcagtaggacgaatcgccctcacatcaaaaagacatttaccagctactttatcgaagtggtggtaaatgtctttttgattatgtaccctgatgtcaacgttgcaaatatcaaggttgggcgaggcgatcaaggtcgtcttgcggcacctttttgtaaacgggtccatttggaagttgcttgagttgaccttttttggtgagctggaattgcaaagtagaactggccgcttgtggctgcgctttacccgtgaaggtgaaaactcgactttttaatgtaagctgagcggcaaaaattccctgatcggtactttcaaagacgccgccttggttggataaggtttcaagatagtagccgctggttgaggaagtgatccggatggcctttttgcgattatcgacttggacgaacgcgtggccgacaagtgtactcaaagtggctttgggaacggtctttttagtgggcttgacgtggctggtgacggtgctggtcgctggctgtttggatgtagacttgcctgtcggggttgtggaagagcagccgcttagcaagattaagatggtaagacatatcagctttttcatttccgagctcctagtgaataaattggatgcaggtcataacgataggaatcacgatcattgatagcaaggtggtttctgtgaccatgatggcagcgtagtcagcatcggcgtcatagagtttggccacaaccggtgcattggtcatgaccggcatgcaggactggagaataaagatttgtttcatcaaggtcggaaccggagcaaaagcaaccaatgcggtcatgagtagcggcgcaaaaagaaagcggccactaaagatgccccatgcttccttgctgagccgcaactgccgccagccggccgtatgcaaggcaatgccgataaaaaacatggatccgggtaccgttaagtcaccaacatatgtcagatccgccattagaaactccgggagcttgatgttcaataagacgagcacaatcccgaacatgaagcctaataacggaggtgagaaaaccttgccgagcgccttttttaaatcaaagcgtgccggtttgggcccatcaccttggataagataaaccccgattgtccaaaaaatagtggtattggccatgtaataaacgaggacgtaaggaaggctgcgaggaccaaacagtgccaaattcaccggtaaaccaataaaaaccgtgttggaattgaagaacatggacttaaaggtgccttttcgcgacttcggtactttcaacaagtaacaaaccagaaatgacaaggcgaaaaggatcatcatggataacaccgggaagaacaaatccggtagcaagcgcaaaagcatgccggcagtgaacttcgatgagatggtgacaatcatataagcgggcaatgcaacttgggttaccaccttggcgatgaccttgctagagtggctgttaaaccaaccgcgcgccgttagaaagtagccgatgatgatgagaatgagaatttcgaaaacgccaaaaacgcttgagataaatgctgtcaaataccgccacttccttataaattattttggtcgccgcaatgtaaacgttcgtcccaattcggcgtagttgggaccggcaagccgtgcgatgggggccaaggcggttgtattcacatgcagtgtcggtaaatcaagcacggtttctgcaaaatgaaattgacggatttctagaataaagagatccgtcatgatgattcccgccgcatcacgaatggggacatattggtaaagaatggtttcaaagcgaatgcgagcagcttgtaaacccggcacctgaatctccgtgctgggaatcaatggtaaatcaatcagcgttaattcactttgatcaggagccagccttgctgcggtttgattcatcgccttggtaagatcagtgctaaccatgtgcacaaccgcttcatggcgagcaaggaggttggccgcagtatcttttggcacttggcgttcgcgcaaaatcgcaaccgataacaacggcaactgattggaaatcccagttgtaaacgaaaatggtgctatattaatgagacctgctgtattctgggtggtaatccaagcgattggccgtgggatgatgctgccggacaaaagcttgtattgttcatgcggtgaaagttcgctggcagataggttaatcatcgtagacctccagtacataacaaatccgatggtgagaccttgcaatagaagctggtgtagcccaaaagtacgtcacgactgcaagtgtagcgcagggaacgaatggcgtcaaaaggacaagctcgtttggcattctcaagcactcactagtttgttcaaagttgtcagggcacagcggcagtcgagcttaatagccaaacgtaaggcatcacccagtgagacttagcgcgaacaaaaaagcgatgtttggcgattgagatcgcaaacatcgccgtataggcatcggaggaccgattgattaatggggactggtatcagtagcagaatttgatccgggatcagtcggagatggtgactgactgctagacgaactggctggcggctggttattttgatcgctaccaggcttttcggaatcgtcgccagtctgcgtaccctgaccgccagtttgagccggattgctacctgacgcgccgctttggctatgctgactttcgacactaggggcggcagaagatggtggttcagtggaaacagttgaggaaacagaatgactagtttgggagtttgttgatgacggtaccgagctgatgactgaacttgaagaaatgcttgaagcagtctgcgaggttttaaaatctgctagactgacaagctttttcttagaacgttgtagaggcaaactagttgttaaatagtgataattatgaggcgttttacccttcaacgagatggtattgttgaactctttcttcaaggcagttgtgtaactcagcacggtgccagatgcgtccttggctgaatattcatcaacagttgatgcctgcttgtgcttgtatgtcgtggtcgtcgtgtaagtgtagacattggcgtgatcggatacaagcgtcaacttaccttttttctgtttaatactaccggtatcattaatgacttgtggctgattatgcgcgtcaatgatgagcaggcgggtgtaggttttggcagtcgttaatttcacataaacagtaagatcgtgatgaacaccgttttcgtccgtgacatcgccagtagcggtataagtcccgcttttaaaagactgggtgactgccgaggtggatgatgcgctactgcttgaagaggaagcgacgggtccttgaaccttggctccccgaagcactagccagatgaagacaccgataaacagaataatcgcgccgattccggctagtgtgaggtaaagcgttctgcgattccggcgaatacgttcacgtcgcatggattgcctcctgagataaaatgaattttgttcaaaactgggatagatgaggatgaaccagaagtatcacaaatgagctgccggtatactgcgatcacataaacctttgtacgtgatacagtcgatagcggcggcccactaaaacactaatgacaggatcatgtctaatatgacttttgcacaatgatgttgccattagcaagtatcaaagtttcaatcggcatatcaaaagattcaactggccagtctggttggttaaacgccataaccggtggcaccagcgtcaccgtatggcctgggtaatcggctaaaaaacgatcataatagccgccgccaaagccaatacgaaaattgtctgccagcgaaaaaccgattccgggaacaatcaaaagatcaggggccggctcaacttgatcggcatgataaggcggctcgggaataccgaaacgactggttactagctgatcaaaaccggggtctggcaggaaaaccatttgacgtttaggcataacgcgcggcaggaacacagctttgttggcagcatgagcagctgcaatgataggggcagtgggaacttcaaaaggtccgctaaccgtgaccccgatactgtcagcttgctgccacagcggggttttcactaatgctgccaatagattttctccagccatctgggtttctttggccgctgtttgtaggcgcttgagctgacgggagcgaaattcggctttcgtagacatgacaacctcacttattttttaggaattcgcttaagacaaccgcttgattatgggtttcatctttagctccatataacatgataaccggatcctgctcgtgttcctttaaagttttaatgaagtttggcaaatccggatttttctctagctccgtcaaataacgctctttaaattcagggtatttttccgggtcatgaccgaaccatttgcgcaattccggagatggcgcaatggttttggcccataaatccaatgccgcgttgaccttgctgatgccacgtggccagattctgtcaacaagaacgcgaaaaccttgggcttggggtttttgataaatccgttcgagtgttactttcatatcgatcacctcatttcttatgataccagtcttggcaagtcgtgaatgttctagtcgcgatacggtatactaattaaaagaggtgtcatcatgattacgtgttatcaaattcaaaaagaccgcaatgtgcaggtggcaacggatgatcaggctaactggattagagtccaatctcctttaccccaagaactgaaaaccttggcaaccacttacggacttccgcaaacctatgtcgatgcggctttggataaacatgaaaatgcacgggtagaagggctggatccggctgataagatgccgggcctaattgttttacggtatccaatcgaaataaccaatgaattaggattccgccaatttaacaccgtaccgctcacgatgatcttactggccgatcgcgttatcacgattatgcagcatccattgcgggcttttgacgacttggccgcgcagccattatcctccaaaccggaagaatttgccttggaagttttgtggttagtgttgcaccaattcgtgattgacatggatcaattaaatgacgaaaccaaacagattgaaggcagtctaggcaaagcagctaaaaatactcagctttatcaattgatggcgatgcaaaagagtctggtcttttttgatgcggccttagagcactcggggaacctactcaagtcattacgtgcaggcgaacgctttttcacggcggctggttaccttcgtcggctgcatgacgtggaagtcgaggtggttgaggctcaaaccatggtccgcattacgaacaaattattggagcagtattcgactgctgtgagtgcgattgtatcaaataacctgaacctcatcatgaaggtcttgacgagcctgacaattattttgaccattcccaccatcgttgggggaatttacggtatgaatgtacggctgccatttgagaatgcgtactgggcattttggtggctgattggcggcaccgcggttttatgcggtcttgccgcatggtggttgtggcgcaaggattacttttaaagtggcagatactttcaacgcccgcaaaattggcttgtttgaagctaactatgagagaaaaatcctatataaaaatcgattctaacgtatttgctggaatcgatttttttctgggcagcattgcctcacttatatgattttaaaatcgattcgaaccgtttcatcgctggcgttaaaacgcgatctttgcgatgtacgatcgagattgtgaaggccggctgatgggcatcatcaatggctaaagtagccagacggtcatcggggttaatcgcgattctggttaagaacccgatcccgacattttggcgaaccaatcgcttgagtaggggcacatcgccggttcgataaacgatattcggcgagaatgtgtgccgttgttcaaaccaggcaaacgcacgggtgtggacaaacccctcacttaaagtaatgaattggcgtttagcaagcgtggcgaaccgaacgcttttgttggctgccaaaggatcgtcttgacgggtgatgatcacaaacggtgccgcattgatttgtacgacatgtaagtcagactcgactaatggaccactggcacccagcacggcgaagtccaacttgccatctttgatttgatcaagcaaagcggccgatccagcttcaacggtttccagttgtggcattaaaccggtattaatcaaatcgggcgcaatcttaggaaacagataaccaccgatgattggaggaagaccaaagcggattttagtttttttatcccatgcaatgtcttgttgggcaagtgtcaactgattcagaataatcgccgcatgggccgccagctgttcgccagccggggtcacactgatatcatgatgacggcggtcgcgaataatcagctgtgcgtgaaaataatcctccagacgcttaatcgcggttgtaatagtgggttgactaactgcgaatttttcagcagtttgtgagaaattgccggttttcgttagcgtaagaaaatagtcaaaatcccgagtattcacgtttagcctcctaaaaaaaagtgagcgcgagccagcgcggttagggatcggagtgtaagtggccttgggcgtgatggtcgctctttgaccattgcgcccaaggtccttacacgcagatccctgcgctggggagcgcgttatggagcagaaaagccagcgcggttagggatcggagtgtaagcggccttggacgtgatggccggtctttgaccattgcgcccaaggtccttacacgcagacttctgcgctggggagcgcgttatggtgtgagctgccacgccgacaaaagaaaaataatggcatcatataaaaatattttatcacttctgttaggtttgactatagtttttgcggcggcgtatcgtctcctcttgtaattaaaagttgtgtccgatttaactggcacaaaaaggagtgtggactttgaaatatacaccagaacagatcctgaataacccatttttaaataaagggactgcttttacccaggaggagcggaaccaatatggcttgaatggtttgctgccaccagctgtacaaacacttgatcagcaggttaagcaagcttatgcccagttgcagaccaagccaactgatttggctaagcgtcaatttttgatgaccttgttcaatgagaatcatgttttgttctataagcttttctccgagcatatcaacgaattcatgccaattgtttacgatccgactattgccgacacgattgaaaactacagtgcgctttttgttaatccacaaaatgccacgtatctttcaatcgatgatccggaccatatcgaaagcgcactgaagcatagcgcagatggccgcgatattcggttgctggttgtaagcgatgctgaaggcattcttggcattggcgattggggcacacaaggtgttgacatctcagtcggtaaattaatggtttatacggctgctgccggcattgatccgagccaggtcttgccagtggtcttggatgtcgggactaacaatgaaggtttgttgaacgacgacctttatttaggcaatcgtcacaagcgcgtatacggtgaaaagtatcaccactttgtcgataaatttgtcgccgcagcagaaaagctgttcccgaacctgtatttgcattttgaagactttggacgcagtaatgctgcagatattttgaatcaatataaagacaagatcactactttcaatgatgacattcaaggcaccgggatcattgtcttggctgggctattaggcgccatgaatatttccaagcaaaaattgaccgaccaagtttatttgagctttggtgccggaactgccggtgctggcattgcttcgcgagtttacgaggcctttgttgaagaaggattgagcccggaagaagccaagaagcatttctacttggtggacaaacaaggcttgctctttgatgacatgacggatttgacgccagaacaaaagccgtttgcccgttctcgcagcgagtttgctaatgcagacgagctgacaacgcttgaagctgtcgttaaggcagttcatccaacagtcttggttgggacgtcaaccgttccgggtacgtttacagagagtatcgtcaaggaaatggctgcccacaccgatcgaccgattatcttcccattgtccaatccgacgaagctggctgaagctaaagcagatgacttgatcaagtggacagatggccgtggcttgattgctaccggggtgccggctgctaatgttgaatataagggtgtcagttatgcgatcggtcaggcgaataatgcgctggtttatccgggcttgggcttgggaaccattgcttcgacggccaaactgttgacggactccatgatctcggccgctgcgcacagtttaggcggaattgttgatccggatcagccaggtgctgccgtgttgccaccggtttcgaagctcgatcagtttagccaaaccgttgcgattgctgttgctgaagacgccatcaagaatgggttaaaccagcaaccgatcagcgatgccaaacaggctgtggccgacatgacctggaagccggaatatcagccattaccggattcaattgaactagacttggaggaatagaactgtgactgcattaagtacatccattcaaagtgtgctgaccatcgttttgctcattgccgtgggttatgttttacggcggcaagggcggtttgatgatcagtttggtaaaaccatctctgatttattgatgaaaattgcgttgcctgcttcgatctttatttctgttttgcaacgactgactttaaacaagctggtaagtctgtcatccggcttagtttacggcttcggtgccgttattcttggctatctgattgcctttttgctggtttggctgcttaaagttcggccaggacggcgtggcactttcatcaacatgttcgtcaacgccaacaccattttcatcggcttaccgttgaacctagccttgtttggtgacaaggcggtgccatatttcctgatgtattacgtggttaacactgtttcaacttggacagtgggtgccttcatcatggcatgggatgatccgactcaggaaaaagcagaaaaaagcggcgccagctttaactggaagaagttattgccagcgccattggttggtttcctggttgcgttagtctttctgttgcttaagattccgtttatccacgttggctggttaggttttgcagttaacacgctggattatgttggtagtttggtaacgccactatcattgatttatatcgggattattttagctgatgccggattaaaggctatccggtttgatcgcgatacgattgtggccttaattggtcgttttgtgattgcgccagctttgattactggtttgatcttgttgggcatgcacgctggcttcaatgtgccgggacttgaagcccaaacgctgatcattcaggcggcggcaccaggacttgcggtcttgccgattctggcgactgaagcccatgccgatgttgaatatgctaccaacgttgttacaacttcaaccgtcttgttcgtggtcgtcgtgccgattctcatgatgcttgttcaaggtttggcataacgttaatagtttgaagtgcaacaaaaaaagagccagctggctctttttttgttgcttttaatgttgatgggcttcgagataagctaaagcgctggtatagtctggctcgtgggtttgttcagtgatcaactcgcgatacttaacggtgccggtgtcgtcgataatccagacactgcgggcatcagtatgattgtcagcaacaaacagtcccatggctttcccaaagtcagcattttgatcggacagtagctgcattttcttgacgttctctgcggcgcaccatgtttgctgttcttgtggggtgttagtcgaaatagtataaaagtcgacgttatcaaacgcgtccatgtcttcgttgaagtgtttggttgaaatactgcaaactcgcgtgttgatgtctggaacaacactgattaacgtcaaacgttgactaagatcctgtgtggttaaagaatgaccttgggcatccttgaccgtaaaagcgggtaacttttcaccaattgctgttggggtaccgtttgtcatgatagcggtgccgtgacgagttatttccatcagaattcactccttgtattgtgtgctgagcgtaagccagacttttgggctggcttacgcgtcatgtgcgtttcccggcggattgggaaattttgaaacgccggaagaacacaggaactgaaactactttgctcaataataacgcctgacacccttagtttaacatgaccacatactaaaataaatgtgcacaatctaattgcaacatgtcgatcagcatataaattgacgcgaatataaatatttatgtaaggttaaattaatggcaaatagcagtccatggttattgctatcctaatgaatggaactcgcgcaagaaagtggcaaagggggcggtcaaatggagcagacattggtagtctatagttcagagacagggtttacgcagcgatttgccttatgtatcgcgcaaacgttacattgcgaaatgattgatgtacagtttttgaccgcttcagatttaaagaatcggtcattggtgatttatggcggccatcttgttggcaataaagtgttgggattaaaatccttttatcgccaatttaaagaagatttgcctgagcagtttattgtgttcggtagcggagttgttcggcgcgaatccgtgaattgtcaacagattgcgcagtatcagcaggagcatcagtgtcaatgcacccgtttctattatctgcaagggcatccaaaactgaatcaaatgaaccttttttggcggattcgggctgcgtgggcattaaaacgctacggaagccgatcctgcccagcggttcaagacgccattcgtccgctagtttcggatgtgactcaggtattgaatcgctcatttgctacggatatcgttgaaaacccaccgttgtcttgacttcagtgggttctgtgttttgtgagcgtgagccagcgtgcttagaagtcggggtgtaagtggcttcttataatccgatttctgcactggggaacgcgttatggtaaaacccgattattcaccctcggcaattgagtccaccaaaatatggaagtatctataaattgatgttggcggctcagtcaagataatctttcgagcgaaagcaaaagtctcggctaagttttttagctttaaggtcgctgctatttcgacaacctgatctaacaatgcacgtgcctttttatgctggccttggcgtgcgcataattcggcacgatggaactgtgcccatagagcaaactcagcgcttggctttttgtcgagcgctgtttctaattggctcagatacttagcagctgcttgattgtcttgccgcgtcagttccaacatgacctgattttccaataagttaaggataagtaacggtgcgctgcgaaaatggcggtagtggtgactacgcttgatggcaattgtcagtaagcgatgttgtgtttcagccggcatggcaatgctgaagatgatgaaaagatataaatcaagttcgccccaattgtctagctgctggagatattgttccgcgacatgggtaagatcgggtcgcactggcaacttatgcgcttcatcaatgaccaatgactgaaaaaagacaggcaaaagcatgcgcgcgttgacagctagtttatttttgagcgtgggtgcttgttgaaagcgggtttgcgcttgccggacgttttccttcattttacgcagagtttcggggaaatcctgggggttggctgacattgtgagggacgaaccaaaataagcctcaagcatccgatcacgattaccgtagtccatgtcaaaatcatcagcggcaatatataaaaattcttccggtgtcgtttctaagcgttccagcaggtgcaacagtttcgtgaccgttatatcgttttgtccgcgctcgaccttggacagataggaactgctgatggtggcatcggctacctgcgcgagcgtcaagcctttatttttccgaatttgtctaagaagcgtaccgatatccatggacttcgcctttcatatatgacatttttcgtttccatcagcataaacctgactatattaaacaacaaggcatctgatcagatgaagctaaacaagatgatgggagcgaggacgatgttgacatggcgttatgggcgtaaatggcagttgctagtctatgcgattgcggctttgttttacagtatgatgaatgtaggggttgcctactgcttgacgatactgattcaggcggcatccgcgcgatctatggcgcagttggtgcaggcagtggtacccagtttgttaattttcttaggtgcctccgtggcaagctggctcgtgatgttcttgaaggccgtgatcacacgccgagtcaatttgaatattaaggcaagaatggcagcttatttgattgatgacgcagatctcgtcagcacccaatcatcagcactgtcgtttatgacgaatgatttaaaaatgatcgaaacaaatggcattgcaagcgaattggccatcattaatcagctgatcatctttggtggcgccatgattggagcgtttgcgtttgattggatgaccgccttagcctttttcctgggcaatctcattccgctaacagtgtcccgagttgctaggaaggggttgcatcgcgcgtcaaaagattggtcaactgccaatagtcactggacatcaggaatcaagaactatttggccgggcgtgataccattcggatttatcaggcacaggcggttgttaaaacgcgtatcaacaggctggcacgcggccttgaagatcagttgaaaaagatgactgttttgaccggcagtatgaacacgctgggcatgctattggcactttggttcggcgttttagccccttttggcatcgggatttaccgcgtgatgatcggcgcttcgaccttagcgttatttatgggcattgtgcaactgtcaaacgatatgcgtaatccgctgattatggttatcgaagcgatgaatcaatggcagacgaccaaaccgctagtcgcaaagatcaagcaagcacagcctagagccgctctgacaagtaaaacgccaatcaccgctggacccattgtacttaaagatgcatcggtaacacttggaaaacaaaagattttcgattcgcgcaaccttaccattaagcctggccaaaaagtgttgattatggcgccttccgggtacggtaaatccaccttgctgcgactgctgatcggcgagttaccgctagccagcggacaatattatcttggtaatgcccaaataacggcgacgactcgtacgcaattaagtcatttatttggcttgattaaacagacaccatttatgtttgacgatacgattcggtttaatttaacgttaggcggacatttttcccagacagctttagacaatgcggtggctgatgccggtctgacagcgcttattgcacaaaaaggatgggattatcaagttggcgaagagggccatcatttgtcaggcggccaaattcaacggcttgaaattgcccgggctcttttgcggcagcgcccgattttgttagccgacgaggtcacttctgcgttggatgaaaaactaagtgatcaactccatacccgactactgcaaagtcctgcaacgttaatcgaagtggcgcatcatataagtcagtcatggcagcagcgatacgatcaggtcattcaactggatgcagatgcaaaagccggttgaagcgggtgatggtgcgtgacgcgggtgcaatggagaatacaggtcaaacaaaaaccgcatgataaaaatgcggtttttgtcgttcttatgcctgaccaatttctttacttaatgcctcaatctcatcaactgtcgtccccaagaaactgattgcatgcttcaaagcggcgtctgtggtgacatcaacgccggcgactcgagctgcttcgactggatcaagtgagtcgcctaggctgagataacgcaaccaccgatcaacggctggttgaccttgttgttcgatggcctgaaacgcttgggtagcaaccgtcaagccggccgaataggagtacgaatataagcccatgtagtaatggctttgccgcatccaagtcagctcagcacctggctcgagttctactgccgatccccaaaaatcggtcagaactttacgcgtaatggcatccaaccgagcagcatcaaaagtttcgccgttatcgatcaagttatagacttcccgttgaaacgcggcttcgagcagatgagtgacaaagttgtggaaataggtatcatttaataaccgtgacaaggcaaagcgcttcattcgcggatctttagcgttttcttcgagatagtgagtcagcaacagttcgttgaaggtggaaggactttcgaccaaataggcattaaagtccgcatccaacacattgtgggcttcttgtgagcggaccatctgagcggtatggcctaactcgtgaatcaaggtgtaaacggcaggcagcgtattactccaagtcatttcgacataagggtgcactccatacggtccagcagtgtaagctccggaatccttgccttgattagcagggaaatcgatccaccgctctgagaaagcctgcatcatctgtgcctggtaatcttgacccatgagtgcggtggcatttttaatatcttctttggcttgttctagtgtgatggttggcgcataacttggatcaatgtcgatttgcaaatcggtataaccaatatgatcgagcccccaaagcgatttcacaagcgtcacataacggcgcatgatcggagctaaatcgttcatgatgacatcgatctgacggttaaacatctcgcgggtaatttcttgatcagcgagtagatagtcaataaccgaatcataaccgcgcatggtagccgtaatcttttcacgcgtgacttgggctaagtaacctgccgccatcgtgttttcataacgacgcaaggtctggttgaattgagcgtaagcggcgcgccgaatttcggtatcgggatgtttttgataattttcttcatacatgacaaacgataacgggtaagttttaccgtgcgccgtaaacgtaccaaagtccatatcaccaaagatgctttggtcgcgaatatcacttggagcctgaaaaaccggggtcaattcggctagcaccttctcggcagctggtggtaaggcaccttgtttggcaactttgatttggcgaataaaaccggcataatcaggagcggtttcgacaactgcatcaagcacgttttcgggaagttgcgtgagttcggctcgaaagaaacttagctgaccgctgatttcgccatcgagaccagttacctgagcctgccgcgtacgcaacgcaggatcagttgtatcagtggagtaaggcataaagccccaatgaatgatgcgactggcaagggctacaatggttccatagtcagctaatgcatccgcaatgacagctggttgtgtcaatttgccttgatacattctgacaaaatccttggtcaaggcccgtacctgctttactgcttcagtgtacgcaaaatcatcgctgaaaatcggggtaagatcccaagtcaactgctgatcgactgcttgccgttttggtagtgttgtctcgctcatgtaaaaagcctccttaaaaaagtgagcgcgaaccaacgcaggcttctgcgttggggaagcgcgttatgtgcgaatcgccgcgtttaacaccaggaaacgcactatagtggctaaagtatagcattgatcacgactaaaacgcatgcgcacgctagcaagttcagcatttttccaaaaaggtattggtacatctatgcttactgccggtaatagcggttcatcttgcgggaaaaataaacttaactaaagctaaactgccttttttcatcagctaccactcgtgtatactgaatatgaacgaatttactgaaaatattcaaggaatcgaggcacatgcatggcagaagaacaaactttagtcttggttaagcccgatggtgtcgcccaaggacatatcggcgaggtcattacccgcatagaacgacgcggattcactattgaggcactaaaagtcacacaggcaacctccgcccaattacatcagcattatgcagcacttgttgacaagccgttctttcccaaaattgaacgcttcatgaccagtggcccgctggtggcgatgattgtcagcgggtttaatgtgatcgaagccgttcgaacgatgacaggcgctacgaatcccggagatgccgcgccaggcacgattcgcggggactttggtcgggaatgggccgatcagacgattcgcaacgttattcacagctcagatagtgaagccagcgcgcaacgtgagattccaatttggtttgcagacaagcaatatgcccctaaagccaatcaatagccgctttgccctagttcattttaatagcatcatctgaaactgtatttgaagaaagcatccaaaaaggcagttgcgatacgatctgtgatcataccgcaactgccttttggtgtcatcggattaatgtagcaggtgcttttaagctgttagtagtaggtgcggcgattgccgaagtttaatttggcaatgatggtgttgggttccgtcatatccggtgattgcagccacaagccgcgggacgcgagctctttaaacagataatttatcgtggcaatttcttcagctgcagggtcgtcaattttggcaccggcttgatgcgcctgtgcaatggcatcgtccacggataaggtgagcgtatccgcgaatgtatcattcaaagtggcatacagtttgcctagttcatcgtccagataagcttctagtgcagtaaaaaaagcgccatgatcggctttacgatcaaaataccgcgctactagctggttgttgtcaatccccatctataacacatcctttttaaatgattttaccatgcgtcactgatcaaaagaaatcatcgttttttaaagctaggtgtagcttaccgccaattgattttagagagcacccgtcgaccgaggaattcttgaatcaagaggtaaaacggtacggttgaggccatgagcggcagatagagtaaggctaactgccaatgccataagttggcgagtgaaaaaataccgttgaaaacaaagaagacaagaaacagcgcgacactgagactcgcaagcaagccggttttaagccggttaaacgggcgcgcaacgactagcaggacattcaaggaaatggtcccgatcaacatggctaccatggtcgaagtggtatcgaaactgagatggaagaacgattccatccaggttaacagaagcgtataaacaacgatgctaatagctgctggtgccgcgactgtcatgaccttttgcatgaactggccggtgacgcgttcgaagttaggctctagggtcaagaagaaagagggaatggccaccccgatagctgaaaccggggtgagattgatggggacaatcggataatcgagcggcaaaaagacgaagattgtcgctaaaatgacggaatacatggtcttgaccagatacatcgaggccacgcgttcgatgttgttaatgacccgccgcccttcgtttagtaccccggtcatggcatcaaaattagaatccaacaaaacgaaatcagcaatcgaactggcggcatcggcaccggaagccattgcaatgctgcagtcactttgacgcaacgccaaaacatcgttaacaccatcgccggtcattgcaaccgtatgccccaaagcctgatatgccatgatgagctgctttttttgatccggggtcacccggccgaagacattgtattgtttaaccagcgtttgaaaatcagcggcggtggcatcagcaggaatggtgctcatgtccacactgcgatcagcaccttcaagatgggcttgcttggcgatgttagcgactgtggtcggatcatcgcccgaaatgacttttaaagccacgccttgggtcttgaagaaatcaaacgtggtgatggcagtcgggcgtaattcatccgtgatgagaatcaagccgattaactgcggattaaccaaaggctgggtaagttgggtggccgttcccaccgcaagcacccggtagccatttgccgcagctttttgaatcttagccgttatggcagctggcagttgatcaccaaatgtaaattggggcgcacccataaacaaggcctgtccatccacgacggccccggaccatttgcgagctgaagaaaatggaacggtctgggtgacttgttgattggtatcggcatcggctgcagctttgattgccaaagccgtttcattgtcatcgttgagtgcgtagacgatcgcagcggcggcgcgggtgacatctttagcggtccgcccgtctgcaggcaatgtgtcggtgactttaagcttgccgctggtaatcgtcccggttttatccaaacatatcgtgtcgactcttgctaaagcttcaatggccggtaatgcccgcaccaagacgcgcttgacagcaaggttgcgtgcagaaacagcgagtgcaacgtttgttaacaaaaccagtccttcagggatcatcccgatcatggctgcactggtggtcaaaatcgcgcgattataatgaccacgccgaatcatggaaaccgtgaaaagaatgacgccgataggaatcaaaacataggttaaaactcgaatgatgcgattgatggtggctaatagctggctttggctgaccttttccgccttagcttctagcgctagtttagcggcaaaggtagcgtcaccgacagcggttacttgcatggtagcctgtcccgatacaacaaatgccccggagagcaaagtgtcacccccttttttggcaatggggcgggattcaccggtcagtggactttcatcgctttcaaggccgttggtagctaccacggtgccgtccaccggaatttggtccccgcgtttgaggatgaccatatcgtccataaccagttgctcaagctcgactttttccacctgaccgttacggatgactgtcgcacgggtggcagcaagaatcgacattttgtcaatttggtgcttggcttgaatctcctgaatcgtaccaatggcagtattgatgatggcaacaccgagaaacagtaaattcttatagctgccagtcgtgataatgagcgcacccaacacgacattgaccaaattgaataaagtgaaggtattgactttgatgatctggctaattgatcgtgtcagtggctttagtggcaggttgtgttggcctgcaccgattcgttgctgaacttgttcttccgataacccttgatcaggtgaaatcttttgctctgccatcgcatgccctccagtacttttcatccattttaccaatccagacaacaagatgccgaatatcacacttgtttttacaaaactttgaagttgttggcgtggttgggttatggttagggagtcatgaaaccgtcataatgagatcaaagttatagaaagaagtgctctcatggtaaaacgaaacccaaatggaacccgatttatcacattacctaatggctaccacttgtggacccagacattaggcagtggcccgattcaattactgacgttgcacggcggaccaggctgcacgaatgaagtgtttgaaaattttgctactgaactggcatcttttggtgtccgtgtctcgcggtacgaccaactgggttcatttttctctgatcaaccggacttttccgatctggctaatcaaaagcgttttctcaatatcgcgtattatgttgacgaagtggaaaatgttcgacaacagctgggccttgatcatttttacctattaggtcagtcctggggcggtgtgttggcgattgaatatggcttgaaatatccgcagcatcttaagggacttattttgagctcgatgattgataatttggatgagtatttggttaacattaacaagattcgggagaccatgttttctagtgatgacgtggcatacatgcaacggattgaagcccagcacgcgtttgcggatgctaaataccagcagttggtgcgtgagttaggggagcaatatcttcatcatgccaaagatccccagccgcgccatttaattagcacgttggcgacccccgtgtatcattattttcaaggtgataatgaatttgtgatggtaggcgcacttaaggactgggatcgacgggctgatatacaccgtctgacaatgccgacttatctgacgttcggtggacatgaaaccatgccgttatcagctgccaagcgaatggctcagacaataccaaatgccactttgcatgtcacacctaatgccggtcatggtcagatgttggacaacccgacagattatttcagtcatttgggtcagtggcttgtgaaaacggatgctggatcacctttattagataattaacgttataatataaatggtaagtatatgtctctcatgtcatggaggtgctttcatgtctgattttgatgaattaaaagaagggctgcttgaaccggttcatgcctttgatcacgcactggagcaacaacccgatttgattattccgttagcagtgattcatttgattcccattgcactgactttaggcggcggcattgcgatcattcgcggtcaccagaaattacgcgcggaaaaagaacgaaccaagcaattgagcctgaagctggaaatgcacaaacgtcatcatggccggcatccatggcgactggcaccagaacatcgtggcgcacatgaagtgtttgcaccggaatatgcagaagtaccggttaataaaaaacatcatttgcatcacaagcattaatttgtattaggtgatttgctttgaaacgactcccgccaataaacccgcggagtcgtttttcggttggggggttcttgcatactctcgaaacgcgttcgccagcccagaaacctgcgtgtaaggaccttgagcgtaatggccaaagcccggccattacgctcaaggccacttacactccggtttctaagcgggctggctcaacgctctttttactttcagattgaatctcgcgtaaagttgggggaaaatgaaggacacaattatgttttggagatgatgtttgtgtcaaccatatttatgcgggttgcgatgcctgctgatattcctgcaatgatgaaagttatcgcgtctgcgcgtcagtttttgggcgcgcagggaattgaccagtggcaggggacttatccggatcaggccgcgattgagcaggacattgctaccggtatcggtcgggttttgattgtggatggccgggttgccggagtggctgctttagttgtcggtccggatccgcattatctcagaattgatggggcaggctggttggcagatgtcccgtatctagcagttcaccgatttgcgcttgacggtagtattcgcggtaaacagttgagtcgggtattttttagcaacattatgagtgaagcttatcggcgcggttttgacgatttgcgggtggatacccacgcgaaaaatgtgatcatgcagcatgcgattacaggtatgggctttgattttcgtggcatcgtttatatggacgaaccggttcctgaacgcaatgcctatgaagttcggttaacatcggtttaatggacgcaaacatggagggtaaagatgcaggacattggtaacttagcacttattttggtaacaacattggtattggcacacgtgagtcggttgctgaaaatgcccgcagttattggcgaattattagcaggaattttaattggaccggcacttctgggatggatttcgtctacgcatacgatttcactatttgcagaaatcggtgtcattattctgatgtttttagctgggttggaaagtgatctggagttattgaagaaatactttaaacccggtatgttagtcgcggttatcggcgttattgtgccagttgtcgttgtctttggctttgcccatctttggggatttaacttgaccagcagtctctttcttggcattacatttgcggctacttcggtttctatctcggttgaagttttaaaagaattgcatgccttggaaggtcgcaatggggcaacgatcttaggggctgcagtcgtagacgatatcttgacggtcttaatcttaagttttacggtcgcagtattaggggaacaaaaaacaaccagtattccgttttggctgcaaattatcgagcaactgttgtactttgttgggatttattttgtggtcagatgggcggcgccgtatttaatgcggttgtctgaaaaattattcccggcttctgcggttaccattatgtcgttattgatttgccttggaatggcgtatgtcgccgatcttgtgggcatgtctgcagtcatcggtgctttttttgccggagttgcggttgggcaaacccattatcggcatgaggttgatggcaatttgagtgcaatcggatatgccgtttttattccagtatttttcgtgagcgtcggcttgaatatgcgttttgatacctttggccgtgatttgggcttcattgccattttgacggttttggcattggtgaccaagtgggtaggctgtggccttggcgatcgtttagcaggcgctagttggttacaaagcaatgttgtgggagctggcatggtgtcacgcggtgagatggcgctcattgtggctcaaattgggtttgaggccaagcttatggacgcagaatactattccgccgtcattgtggttattgtcatcacaacgttaattgccccggttattttaaaagacgcactacaccgcgaacaggaacttgtataatagagagcgtgaacaggagcgcatagaaatcggagtgtaagtggccctggaccgaaatggccgggctttggccattttgatccagggtccttacacggagatttctgcgactgtgagcgcgtttaaggagagagcgtgaacaggagcgcatagaaatcggaatgtaagtggccctggaccgaaatggccggtttttggccattttgatccagggtccttacatggagatttctgcgactgtgagcgcgtttaaggagagagcgtgaacagaaacacatagaaatcagcgtctaagcgctcatacctgttgtcggcgttactaatagacgacacttaatggcttttttttacagcctttcattcatgtcaaataaggaggatctcaatggcaacattattttttgattttgatggcacggtagcagattcagaagcaggaatcgttgcagcattaaagtacatggttcaggatcgcggattgcgtccgttggataattcagcctatgttcaatttattggcccggcgttggtgcaaaagcttcctgaagtctggccggaattggatgatattgaagttaagcgggcaattgatgcctttcatcactattatcaagaggaaggcttatatcaagctaaactttatcctggctttctagatacgatgacggcattgaaggaacaaggacaccatctttatattgcttcggctaaacccgagatgatgctgcatcgccttgttaaacactttgccttggatcgttactttaacgctgcttatggggcaagtgacgatgagcagacgcgcgtcacgaagacggatgttttggcctatgccttaaaagaaaccaatgaagatcctgctaaaagtgtcatggtcggggatcgcgcgaatgacatgattggcggcttggacaatcacgttcagttactcggtgtgacttatggctttggatcagccaaagagctagaagacgcaggagctaaggtgcttgtcgataaaccggaagcaattccttcaggcttggcaaaattggctaaataataagcgttagataagtttgaagctattaaatccctgatggcatcacgatagggagacaaaaggcgaatgcattttccatatgtgcggagaatgcattcgcctttattcagtcattagcgattctttttagcggcttgctgtggccgaatgaccttggaaccaatttcattcaataacttcacgaactgttttgctttgcgttcgcctaatgctgcgacccattcgttgaactgctcattggcatttttcgtaatggccgcttcgacctgtttgccaagcggcgttaactgtagcatattgcggcgccggtcagcttcaaactttgactgggtgacgtaattcaagttgcgtaaaactcgcagttgacgggctaccgcgggcttggttacgccacgcttattcacaattgcagttaaactgatttccggatcattggcaatgtccgataaaatccgatattgctcaaaacttaaatgatacgccgccattggttccgagatcagttcattgatattcttgaacgttgaaaaataggcatccacatatgcctctagtaagggtttatcagtcatatttcttcctccgaatattagtttaacaaatcacgggtcacatgtaacttgaaattctgaaaagttgcggtacacttttcagttatgtaaaggtcttgaaccacttatggaggttaataacgtgcgaaaacataaaaaagcttggctgatcggtattctgtcggtcattggggtgatggtggccgggctggtgggtgccagcttatatttttatcagtatgcctttgttccatccaagaaatctttcttgagtgggaaggaaagccgtattattacggatagtaaagtatggcttaaatctgtacataaggaaacctggactgaacaggcagccggcgacaagctcaaattagtcgcggattatgtacccgcagccaaaccgaccaataaaacgatcgtggtcgcgcatggttatatgactaacaaagaatacatggccccgcaaatcaagatgtttcacgatgccggatttaacgtcttggctcctgatgatcgcggccaaggccagtcggaaggaaactatatcggttacgggtggccggatcgactggactatctcaaatggattaaccagattataaaaaaacaaggcaaacagagtcagattgccttgtacggggtctcgatgggcggggcaaccgtgatgtatcttagtggcgagaagttgccgccgcaagtgaaaagtatcgttgaagattgtggctataccagcatcattgacgagcttgcttatcaagccaagtcaatgtttaatatcccgaagtggccgttggtaccggcagttgcgctaactgcgacgctcaaagccggctacaatgtttttgatgccagtgccattgacgctttgcacaaaaacacccgaccgattttattcattcatggcagtaaagacacctttgtcccgaccaagatggtttatcaaaactatcgtgcggccacaaaatcgaaaaaggctttgtgggtcgtcaaaggcgcggcacatgcccgtagttttccggaccatcagaaggcttataccaagcgcgtggttggctggttcaacgctaattggtaaccgttgtatgtctgcttaatgggtggcagtatgagcaacacgggttaagacggtgtaaatttttttggcatcgcttggtgttccgcgcaactcgtaatcggccaaaaaaggcgcgtcgaattccttggcgtagcgtttggcggtcaaacaatattgttcattgaaattgcggttgccagaaccgatgatgcctagacaaagcttggcattgtcgccttctgccagatagtcacccatggcattggtcatcagttccttgacgccgttatcaatgccgttaccaccatcgagataggtgggtaccatcacaaagaacggtttcgtttcgccgtcactttgcgtcgcctcggaaatttcttttagaacaatcgctggattttccggattctgatcatgttgggtttgtgcatattcggctagacgtttagcaaatgcgcgcgtgttacctgaaattgaaataaataagatgcgaataggttcagtcatgtggcctgcctctttcattagagttttgaaaataacaatgatgcggctgatcgtcaaggtgagccggttagaaaaagaagtcgcggtgctgtcactgatagcgccgcgactctttttaatgaaatggatctgatgcaatcgatacttgttgccaaaatgagctggtttgcaacattagaattcttgatagaccgctggatcctgattgtttaagcgtccatctgatttagttaatgcgtcaatcgcagccatttcttctttagtcaggctgaaatcaaaaacatcgagattcgtgcgctggcgggaaaggtgggcagactttggaatcgggagaatgtggtgttgaagatcccaacgcaaaataacctgaccaacattcttgccatgggttgcggcgatctgtttaatcgctggttcttgcaaaaccgctccccgccctaaaggactccatgcgaccgtttgaatattgtgcgcgtcatcatacgcgcgttgttcttgctgattgaaatagggatgcaattcaatctggttgactgctggcgtgaccccggtttccttgatgagccggtcaatatgctcaggcagaaaatttgaaacgccaatagaccggatcagtccgaagcgttgtgcctgaatcagcgcttgccatgcttctagataaagatcctctttcggattcggccagtgaatcaaataaaggtcgtagtaatctaaaccggctcgatataggctttcttcgatggtatcaatcgcctcttgataacggtggtggcgtcccggaagtttagacgcaacaataagctgactacgtgggatcccactttgacgcactgcttcgcccacagcaccttcattttcataattaaaggctgaatccaacaagcggtaacccagattaagggccccaaccatggctcgaaccccgttagtcccggttaatttatatgtgccaaaaccaatggctggtaaaacattgccgtcgtttaatgtatagtgcatttgagaaacctccttgtgaagttgtgacccgatgcaacaccgaatgagtacatgtgaaagtgaggttgccaaccagcgccaacaccagcaatcatacggcgaaaagcaatttaggatgatggcttaatgatgaccgacatgcatcaccattaagtgtagtccaaatgtcaggaagcgtacaagtcatgatgacgcttcgtgtataatagggccagatgcgagggaggggatccacacgagaacacaacaatggcgaggcgtctcccgtagttggtttgcattatttacgctgatcttttgggtacttctttttgttgaagcctttagtaccggtatgatgttgaccattgggacacccgcacgaacagagcaaatcgttgttaaaagccaaggtctgcaacaactcacggatactttaaaccatgatctggtgacaacggcgaaccaaaatggcgctgctttgaatagtgacactaaactggtcacacttgatgacactcagcggcttgccgtaaaaatgatcacggccagtgcagctaaccaaacgcatatttcactggcaaccattaaagaaagtctgacgagtcggcttcagacagcggcgaaaaatcaaggtcaaaattttgacgatcaaaaagtgttggcgagtctcaatgccaaacttgaatatgaaatcaatgagtcaatcatggagcaaggctgggggcttatttatccgttgttggtccttatgacccagacagcggtgattgtagccgcaattttgctggtgattgttctgctcattatgttaaaaacagcacactcatggcggcggtttatggccgttgttgggcggtcgacttacgcaatggggtattttggtggtttcatagcgattcttgtaactgcgagtccattgttaggcatgattagtacgcgggcaccgttaaatacgcaattggcgagtgatttaattcgtgcatactcaccgctatggcagcgagtggcaggttggaccattgtcgttggtttaatcattgcggcaattagccatttcttaccacgtcctgccttgcttgcagatgattcggcgaacccggcagcagaaaggtaggttccatgaaacgaaacaactggatttggttgggcttacttggcatagttctggttgtcagtgcaggttggtattggttccacaaccagtccgtcaacacatccgatcaggagcaggcgtcgattggcaaaaccgcaacgctttatttgcatggctattccggtggtgccgggtcgaccaacacgttaatccgtcacgctaaacaggcgggagcaaccaaagtccttactgcaacggtgagtaaaaacgggaaagtcagttggcttggatcgcctcaccatgttcgtaagccaattgtgcaagtggtctttgaagacaatcgcaatccggatgccgtgaaatgggctgattggctagcgacggttaatcgtcagctttaccaacgttatggtgtgcgcaacgttaactttgtcgcccactcaatgggaaatatggcggtgatgttttatgcaattcgcaatcaagaccagcaaaaactacctaaaataaacgcctatgttgccattgccgggcattttgacggtatcattggtatgggcgatcaaccacatcaaatcaagttagctgctaacggctatccatccccgttagacgaaaattatgctgagttggctcggatgcgcgatcgttttccaaaaggggttaaggtgctgaatatctacggtgatcttcgcgatggttccgattcggatgggcgggttagcaacaactcatcgcgatcgttacgatatctggttagcccacgcgcagccggttaccgggaaagagaatacttcggtcgcgatgcccaacacagcgcgttacatgaaaatcctaaggtcgcccaagcggtagatgcttttctctggtgagactcacggttaggtgcgatcgtatggtgacacaacaacgcgtccaccgagaaaactggccatatagacatcaccgggttcgtatccttgctctgccaagcgagccttaagccatttctcatcatggtcaatggcgtcaagtgcggccgggtcaatttgcccatctaaaatgagtggatatttgatggtttcgtcgccttttaaaatgacatttaactggccattttgttcaagataagcctggcgaacatcgcgtaaatcattgacgccggcagctcgtagtttataagcaaggtcgttagcagataagcctacccgtgtggcggtatccactttgatttgaccatgttgaacgactaataacggttcgccatcaatcacccgtttgagccaacgattgtggttcgtcaggtatttagtgctgaaaacgattaacgtccagatcagcagcacgttgacaaactgcaacagaccgatatcggtattataaataacgccgccgatgatgccgccaagaacgtaattctgcatttgatcgacaatggttgccggtgcaagattacctttaccggtgagcttgatttgcgcgatgaagacaatgaagcccaaaagcagcttcattgccgtcacaaagtatggatcctgaaaaagtcgcatatgaatctccttatttagtgatgaactgagcttttggcacaatcaaggtcgttttagataactggtaactgttattatcggcattaattgtgacggtgtacatttcttttgtggagcggccgatggtgatcagcatgccggtgtgaacagtattgctgttggcataaagctgacgggtggcgacatgcttttgggttgccacgctgcgtaacagggtggcaacggcttgggaatcagcgttggccgttcgactagcctgaagatcgcgaacttggatgccgatggtcaggagttcaactaaagcaactagcaccaaaagatcgcggtatttgttactgcgtttgtggcgtaagaaatacagaagataggcaataataagcaaggcaccgattaaaataatggtatatcgtaaggtgctttgccaactgttctgctgggttagcacggaataagcaaaaaaggtagttcccatagtgcacctccataaatcatggtctgatcaaatcataacaagaataatagcgagggtgaagttgttcttgacatggcttatcgcggtgttatgatgaattcaatttatgacaaacacattgctttgcggagaagagtaaccgaagcgcagatcgacagcgagcctggacagtgtaagcaggtgatcggctaatcggtgaagatgagctccaaatagcttttcagtggttcacgccattgaaacgggtgcacccgttatgatgccaggtatcagttttggtactgttgaggtgttaatgttaaattaacacgaataagggtggtaacgcgcaccgtcgccccttgatcggattcgatcaaggggcttttttcgtcccgtgacggctatgacttaccgcatcagtcgagtgtgttgcataaaggtaccgactagttggttgttccattgctgcgtgttttcagtggtggaatattaatttgtagttgattttgcgtaggcatccatttttgaatgtgatggttattcaagactgtagtgcgtttgccatgacgcgtttatagggatagagatctgacctacactccggtttctaggcggccctgttcacgctcactttctataacgcgctccccagcgcagggatctgcgtgtaaggaccttggtcgcaatggccaaaaccgggccatcacgcccaaggccacttacactccggtttctaaccgggctggctcgcgctcactttccataacgcgctcacagggccagaaacctgcgtgtaaggaccttggtcgcaatggccaaaaccgggccatcacgcccaaggccacttacactccggtttctaagcggccctgttcacgctcactttcttttaggagggtttcacatgacagaagaagttcaaaccaaagccccttttcgtgctgatttagttggtagtttgctgcgtccggagcggttgaaggttgctcatcagcagcttgggatcggtgagattcagcaggatcaggagctggcgattcagcatgaagccatcaaacatattgttaaaaaacaagtcgaactcgggtttaatgccgttactgatggtgaattctcgcggcgttactggcacctagactttttctgggggctgaatggctttgaaaaggatgatgcatggaagtatgaacgggactttaaaggcgggattaatcctgctgccaatgttcatcttgctggtaaggtcagctttaatcccgatcatcctttctttgccgcctttaaatatctcaagagtattgtgccagccggggtcttgccaaagcaaacaattcctagtccagcgctgttgtttagggatcatcgcagcgataactggtcgaagtactatgcttcttttgatgattatttagctgatgtggtgcaagcatacgtggcaactattgaacacttttatattttgggtgtccgttacttgcagattgatgatacgaattgggcttatctgattcaaaacctaaaagatacagagaacgacccgaaacgacaccagcattttgtcgactttgccaagctggcgcatcaggtcattaaagcagtgttaattcgattacctgaagatttgaccgtaacttcgcacatttgccgcggaaatttccagtcgactttcttattctcgggcggctatcagtatgttgctgatgaaattggcgacttgccttatgacggattattccttgagtatgacagtcagcgtgccggttcgtttgagccattaccgcagctgtggcaaggcgataccaataagcggattgtgttagggttgattacgtcgaagtttccggagttagaagacgaggaaaaagtgattgaacgtatccatgctgcgactgcttatgtgccactgagcaacttggctttgtccacgcaatgtggttttgcgtcaaccgaagaaggcaacaagctgaccgaagatgatcaatgggcgaagttggccttggttcagcgtattgcgcatcgggtttgggaagatgcttaacagataagccggctagactcaaaattttttgaccctatttggcatgatgtcatgtcattctcagatttttttcacaccggtgggattgtgttatatgatgaataggtaagctattgagaaggagatccttaatttatggcaaaagttgaaagctttacgttagatcacactgcagttaaggcgccttatgtccggttaattaccaccgaaaaaggcccgaatggcgatgaaatttctaattatgatttacgcttggttcagccaaacaccgctgcgattgatactgccgggttgcatacaattgaacacttgttggcatcattattgcgcgatcgcatggatggcgtgattgattgttcaccgtttggctgccgcaccggctttcacttgattacctggggaacacacagcaccacggaagtcgccaaagcgctgaagtccagccttgaagcgattgctaacgatattacctgggatgatgtacccggtgttgacattaagagttgtggcaactacaaagatcacagcctgttttctgctaaagagtgggcaaagttgattttgagtcgcggcatttctaacgatccatttacccggcaggttgtctaatctgacgagcattgattagaaccaaaaatggcactgcacaagttcgaatagcgaacctggcagcgccattttcatgtcaccatgtttaactgaatagatcaatcaaccaccggccaccatatagcaaactcatgctataggcgaagatggtaatgggtttgccgagtataataatccagaagaacctggtaaaggtcattttggtgagaccggcgagcaaacatagcacatcatctggggcaaccggcaacacaatagcaagggtaaacaggtgatcaaagcgggtctgattcttagtgtagccgatgtatttttcataagttttttccgaaattaaatacgtcagcaggggcttgccaaaacggcgggcaagaaaaaagttaataaaagatccgatcgcgatgccgatgtagttgtagagaaaaccaaaccacgggccaaaaagaatcacacccgcagcggtactgatgccgcctggaatgatgggaatcacgacctggatgacttggatgacaacgaaaaataaagctccggttaagccgagtcgggcaatgtaactttgtaaaaccttgacatcagaaagaatccctagatcgtaccaataaatagtgacgacgactaaagcgatcacaacgatcagggtggcaagattgatcaaatggcggacattttttggagtcataacgttaagcctcagaacgatttatcatcaagaaaagttctatgctacaatgagtcaagcgtaccaaacatatgtactgaatggagagcttatgtacgaatactttgaaggcacaattcaggccgtaacgccggcgtacattgtcattgatgtcaatggcatcggatttcgcctgctggtagccaatccatacgatttcgaagcgggaaagcagacccggatttatgtgcaactcatcatccgcgaaaatgatcaaacactttacggatttgaaacagcagcggataaacgaacttttaaccagttgttatccgtcaccggcattggtccgaaatcagcgttggcaattttggcaaatgtttcaagtggtggcctagcaactgccattgcccaggatgatgttaaatttttgaccaagtttccgggcatcggtaagaagacggccgctcagattatcctggatctaaaaggcaaaattacgaccgatgctcaaccggctgccgcaacgatcatgccgaccgccgatcaagtagcgccggagctggcagatgccttggctgcactggttgccttaggatacacccaacgcgcggttgatggcattaccgatgctttgaaagcctttgacgccacgacgaccgatgcttatctgcgtgaaggtttacgcttgttgagcggacgagcataacgttgattatactggagcagcaggacatcgacaacggtaagactttttcagacaatatagaaggggcgtgagtttttgccagacgcaaacaaggatcggttagtttcaggcgacattgatgatctgaatgaagcacaaattgagaaaagcttacgtccacggcggcttgctcaatatattggtcaggatcgggttaaacatcagctgaccgtttatattactgcggccaagcaacgtgaagaatccttggatcacgttttgttatatgggccgccgggattaggcaaaaccacgctggcactggtgattgccaacgaaatgggcgtgaatatccgtaccacttctggaccggccattgaaaagccaggtgatttggtcgcgttgctgaatgagttgcgccccggagatgtgttgtttgtcgatgaaattcaccgattaccaaaaattgttgaagaaatgttgtactcggccatggaagacttttatattgatattgtcgttggccagggtccgactgcccatccggttcatttccccttgccgccatttaccttgattggggccacaacgcgagctggtatgttgtcggcaccattgcgcgatcgatttggcattagtgaacatatggcgtattattcgcctgatgacttaagtgagattgttaaacgctcagcaaatgtcttcaatatggcgattgatgcagaaggtgcctacgagattgcgcggcggtcgcggggaacgccgcgggttgccaatcgcttgttgaagcgtattcgggattttgctgaagttgccggcaagagcccggttgacttggcaatggtcgatcatgcgcttgatcagttgcaggtggatgcccaaggacttgatcagattgatcgcaagttattaaccttcatgattcgtgactaccaaggcggaccggttgggttatcaacgattgctgccaatatcggtgaagaaatggctacgattgaagagatgtatgaaccctacctgttgcaaatcgggttcttgaaacgaactcctcgtggacgcatggtgacgcccgctggctttgcccatatgggaatgacgatgccgcaatcctcagacgagcagtcgccatcaaaaaacaactaaatgaaatgaatggaagcgaacaagttgcaagacaaaaaacgttatcggcgcgtagaaaataaagattatcaactttcggattttgattatgacttaccgcatgaattgatcgcccaaacaccgctgaaagaacgcgatgccagccgtctgttggttttaaatgctgatactggcgcgatgcaggataagcatttttatgacattctggattattttaaaccaggcgatgcgttggtcatgaacgacacacgggttatgccggcacgactttatggtgtcaaaccggaaaccggtgcccacatggaagtgctattacttaataacacttccggcgacgactgggaaactttgatgaagccagcgcgcaaggcaccagtcgggacagtgattgattttggtgacgggttgttaaaggcgacggtcaccaaagagctggaacatggcggacggatgatccattttgactatgatggcatcttcatggaaattctggataagctcggtgaaacgccgctgccgccttacatcaaagaaaaacttgaagatccggaaatgtatcaaaccgtttattccaaagagctaggatcagcagcagcgccaactgccggattgcattggacgaaagagttattgcaaaaggtgcaggataagggcgttaagctggtttatctgacgctgcatgtcggtctcggaacatttcggccggtggtagaagaaaatattgaagcgcataagatgcacagcgagttttatcgtctaacaccggaagcagctgcaactttgaatgaggtacgcgataacggtgggcgcatcattgctactgggacaacctcaattcgaacgcttgaggcgattggcactaaatttgatggtgctatcaaggcggattctggttggacagatattttcattaagcctgggtatcagtggaaggtcgtggatgcctttatcaccaacttccatttgccaaagtcaaccttggtgatgttggtggctgcgttcacaggccgggatacgatcttgaacgcctacaaacacgccattgaagaaaagtaccgattctttagctttggcgacgcgatgttcatttattgatgatcgatcatgtgacccgctactgtctgcgggtagtttacgccattgatcgtctctgaaggtatataaaaaccggtttgcgcgtttgcaaaccggtttttataacggacgggatcacatcaacacataccaacagacatgtctcgatttttcttttaacgcatcgctgcgtggaacaacgtattcatagacgatcacaatggccaggtcaaaacccgggaagtgcgaaaactacggtaacggtgatcccgtccttagctttattttaacaggaaaaaccagtagaaaaaaggataaagctcggtgatcgtgggccagcgctttataagaaagttgttgatcatctgctggacaggtttcatttgtgaacggtcctgcagcgtttgggcgagtcacttacttttaaatcacaagtaactctgttaaactggcataacgagaaaatggataagcggtgctgcgagggcattgctgtgaataaggagtctgtatggaaccagcagttaaatatcgtctcattcatcaagataagcatagtggtgcccggttaggtgaattgatcacaccgcatggaacttttccaacgccgatgtttatgccggtgggaacccaagccagtgtcaaaacaatggcgccagaggaattggacacaatgggagcaacggttattttagccaacacctatcatttgtggttgcgtcccggtccggatttaattgaagaagccggtggattgcaccgtttcatgaattggcacaagggaattttgacggactcaggcgggtttcaggtcttttcgctagcagatacccggcatattacggaagacggggtcaccttcaagaatcatctgaatggcgcgaaaatgttcctatcaccagaaaaggcgattgcgatcgaaaacgcgttagggccggatattatgatgagtttggatgagtgtccgccgttttttgagagttatgattatgtcaaaaaaagtgttgcgcgaaccagtcgctgggctgagcgggggttaaaagcgcataaaaatccggattggcaagcgctgtttggtattgttcaaggagccggcttcaaagatcttcgtgaacaaagtgccaaagacttggtaagcatggattttccgggatattcaattggcggcctgtcagttggtgagtccaaagatgaaatgaaccatgttttggacttcaccacacctttgctgccagaggataaaccgcggtatttaatgggtgttggttctgctgatgcgctgattgacggggcattgcgcgggattgatatgtttgattgcgtcttgccaacccgaatcgcacgaaatgggacgtgtatgaccagtcgcgggcgtcttgtcatcaagaatgccaagtatgcccacgactttggcccgcttgatcctaattgcgattgctatgcttgccgcaattacagtcgcgcctacattcgtcacttgatccatgttggcgaggcattcggtattcggctaacaacctaccacaatctttatttccttttacacctcatgcagcaagtacgtgaagccattgccaacgatgatctgcttgccttccgcgaagattttttcgaagcttatggttataacaaggaaaaggcgaagaatttctagattgtttggagcatggtccgaaattctgttacactgttgaatgacaaactaaaaaaacaagaggtgcctaaattgggaaatggtaatgtttcaatgatcgttctgctggtgatctttgtagcgttcatgtactttggcatgattcgcccacaaaaaaagcagcaacaaaagcgtcaggaaatgctaagtcagttaaaaaaaggtgatccgatcgttacaattggcggcctgcatggtgtgattgattcaattgatcagcaagcagggaccgttgtgattgactcagacggtatttatctgacattcaatctaaatgcggttcgcggcgttgcttcacgtccggcaaccccaaccccggctccagcagcaaaagccgaagcctccaacacagatgaacagcgtgtggctaaggaagcatctgatactgcggccaagtccgatgatcaaccggctgctgctgacagcgatgccaaagcagacgatgacaagcaggcttaaggttaaaggttaatgatgttaacagagagaccggttcttgactggtcttttttttacggccataagttcaaaaaaatacaaagtgaaaaacgttgaattcccctgacaaatcagcattgacagtgaacaagcaaaattttcgtgaaaaagttcactaaaattgtttacaaaatcacaatagcaaggtatgatgttcttgtgaaatggttaacaaaaattctgcgaattgcttggaggtaagctcatgcttaagaatactgcgaaggctgctactgaagttgatgtgaaaggcatgattgatgaactggttgccaatgcgcactcggctttgaagatcatgaagacttttgatcaagaaaaaattgatcatattgttcatcggatggcaattgccgggttagatcatcatatggaattagcgaaactcgctgttgacgaaaccggccgtggtgtttgggaagataaagccattaaaaatatgtttgccactgaagaaatctggcattcgattaagaacaacaagaccgttggcgttatcaatgaagataaacaacgcggcttggtatccatcgccgaaccaatcggggttattgccggggtaacgccggtgaccaacccgacatcaaccacgatctttaaatccgaaatttccatcaagacccgtaatccgattatctttgctttccacccgggtgcacaaaagtcttcagcgcgtgcgttggaggtcattcgggaggaagctgaaaaggccggattgccaaaaggggccttgcagtatattccggttccaagcatggaagcaactaagacactgatggatcatcccggcattgccacgatcttggcaaccggtggccctggcatggttaagtcagcttattcatccggcaaaccggccttgggtgttggcgcagggaatgcaccggcatacatcgaagcaagtgccaatattaagcaagccgttaatgatttggtcttgtccaagagttttgataacggtatgatctgtgcttccgaacaaggggccatcgttgattccagcatttacgatgccgtgaagaaagaatttgaagcccaaggtgcctattttgtcaaacctaaggacatgaagaagttcgagagcacggttattaaccttgagaagcaaagtgttaatcctcgaattgttggccaaagtcctaagcaaattgctgaatgggcagggattcgaattcctgatgacacgaccatcctgattgccgaactaaaagacgttggcaagaaatatccgctttctcgggaaaaactgagcccggttttggcgatggttaaagccgatggtcatgaagatgccttcaagaaatgtgaaaccatgttggatatcggcggcttgggacacaccgcggtgattcacacagctgacgacgaattggcattgaaatttgctgataccatgcaggcttgccgaatcctgatcaatacaccttcttctgttggcggtatcggggatctctacaacgaaatgattcctagtttgacgctgggctgcggctcctatggcggcaactcgatttcgcacaatgtggggacggttgacttgttgaatatcaagaccatggcaaaacggcgcaacaacatgcaatggatgaaattgccgccaaagatttatttcgaaaaaaactcggttcgctatctggaacacatggaaggcatcaagcgcgccttcatcgttgctgatcgttcaatggaaaagctgggtttcgtcaagatcattgaagacgttttggctcggcgcgagaatccggtacaggttcagacgttcgtggatgttgaacctgatccatcaactgatacggtcttcaagggaaccgatatcatgcggtcgtttggtccggataccgtgatcgcgattggcggtggttctgtaatggatgcagccaagggtatgtgcttgttcaacgatgctggcgatgcggacttcttcggtgccaaacagaaattcctggatattcggaaacggacctacactttcccgaagctgaataagaccaaactggtttgcattccgacgacttccgggaccggttctgaagtgacaccatttgcggttatcaccgattccaaagcagggatcaaatatccgttagctgattatgctttgacgccagatattgcgattgtggatagtcagtttattgaatcagtaccgccagtagttgtggctgattccgggatcgatgttttgtgccatgcaaccgaaagttatgtatcaaccatggcaacccactatacgaagggcctgagccttgaggcaatcaagctagtgtttgaaaacctcgaaaagagttatcatggcgacattgcggctaagtcaaagatgcatgatgcttctaccattgcagggatggcgtttgccaatgccttgctgggaattaaccacagtattgcccataaattaggtcaggcgttccacttgcctcatggtcgctgcatcgccatcaccatgccacatgttatccggttcaatgctagtcaaccaaagaaacgtgcaatctgggccaagtacagttacttccgtgctaacgaagactatgcagaaattgcccgctatcttgggctgccaggaaagaccaccgatgaattagtggaaagctatgttcaagccttcattaaattggcacatagcgtcgggatcaagttaagtctgaaggatcagggagttcagaaagcagatctggacaagcaagttgatcgccttgctgaacttgcttatgaagataactgcacggttaccaacccgcaggaaccattgatcagcgatttgaagcacattattctcgatgaatatgaaggaacggattcaacattctaagtacgcacatgctaatcatttcacgatgatcggcaattgttcatcagataaaccgtttgcgtcggtcgtcattaaacacgtcaagaaattgacgtgtttttttgtgcaagtcatggcataatgtagtacagtgactgcaaattaaaagtaaggatgtaaaatgacaccgaataaagaggattatcttaagttgatttttgagatcggcggcgataccgaactggtctctaataagcaaattgttgcggggatgcatgtctctgctgcctcggtcagtgagatgatcaataaactgggcgaagagaagctagtagcacacacgccttatcaaggcatccagttgacatcggctgggcgaaaaaaggcggctatcttagtgcgcaatcatcgtctctgggaagtctttttagttaagtgcttgaagtatcctgccgatgcagttcatcaggaagctgagaaattggaacacgccttgacgccagaaatggcaaaacgtttggcggccatgttaggcaatcctcaatattgccctcatggcggtgtgatccctgatgctgacggccactatattcagcagagtcgcgtcactttgggagcgatggaagtcggccaaaagggtcatattgaacggttgatcgatgaggtttcattgattgattacactgtcaaacttgatttacgccttgatgacgtctttacggtaaccgccaaaacgttggatgcagtcgtcatcaaactagatcgaactggaaaagaattggcagtcgatgctgatcgcgctgctcacatatttgttgaattgtaatcaagacttgggaaagcagggtcatatacatgccagaagaatcgcgcgctgtgatcattattttcggtgggtcaggagatttagcttcacgaaagctttatcctgcattgttcaatctttatcgccgcggagtgcttgctgaacactttgcagttatcggaactgcccgccgaccatggagcgacgaacattatcacgaagtcgtagcaaatgctgttgcaggtgcacacgcggatgctgaacaggtgcacgcctttgcccagcactttttctatcaaagtcatgatgtaaccgatgcagatcattacatcaccttgaaaaatcttgcggcaaagctggatgatcagtttgcagtcggcggtaatcgcgtcttttatatggctatggcaccggactttttcgaaaccattgccagtcatcttaagtcagaacatctgttgacggatgctggattcaatcgtttgattattgaaaaaccgtttggacatgattatgctagcgccaaagcattgaacgattcattgaccgcaacgtttgacgatgatcagatttttcgaattgaccattatcttggcaaggaaatgatccagaacctactggcgtttcggtttgataatgccatttttgagggcgtctggaacaaagactttatcgacaacattcagatcacgttatctgaagctgtcggagtagaggaacgtgccggctattatgaaaaggcgggtgcgttgcgcgacatggttcaaaatcacgtgatgcaagtattgtcttacctgactatgcccaagcctaagtcgtttacggcaaccgatattttaacggaaaaagataaggtgtttgctgcgttaaggccttatgatctggcagcagcaaaggctaactttgtgcaggcacaatatgtggcggcgcaaatagatggcaaaacggttccgggttatcgccaagaggaaggggtcgcaccggattcgcaaacgccaacttttgtcgcaggcaagattttgttggatatgccacaatggcaaggcgtaccgatttatattcgaacaggcaagcggctgacgcgtaaatcgacccaaatcacattaacgttcaaaccggtgaccgcgccgttatttagtcaagcagaagcaagccgcccggatagcctgacgatttacattgaaccgagcgaaggctattccctgcagcttaacggtaaagcattgggaacgggttttgacgttgaaccggatgagttgcgctatcgccacgacccgacagcggctgcagcagctccggaggcctatgaacgtttaatcagcaatgtgctggaaggcgatcagacaaacttcacgcattggtctgaattatccgcttcatggcgatttattgatgccattcaagcggcatggtcccaggaaacaacaatgccaacttatccggcggcaacaatgggaccaaaggcggcatttgatttacttgaacgcgatggccgcgaatggttctggcaaccacggcgcgttcagctagccgattgatgatgatactgaacaaagggacggagaccaataaaaggtcaaagcctcttttttaagtgagcgcgagccagcgcggttaggagccggagtgtaaggaccttgggcgtgatggccgggctttggccattgcgaccaaggtccttacacgcaggctcctgcgctggcgagcgcgttatggagcggaaaagccgacttctgcgcaggaaagcgtgttatggagcgcaagtccgacttcaagagttgttgaaacgtgtcaaggtcccggggaggtgagcaaacacatggcgttattcgaattacccttacaaaacgatacgtcacgtaaaattattcatctagacatggatgcgttctacgcttcgattgaaatgcgggataatccgcgactacgccataaagcattggtgattgctcgggatccgcggacgaccgggggcaaaggcgtggtcaccaccgcaaattatgttgccagacgttacggtgtccactccgcaatgccagccaatgaggcactacagttagtaccacgtaaggagctcgtttttaaaactccggactttcccaagtacaaagcggtgtcggcacagattcacactttatttcatcaggtgaccgatttaatcgagccggttgcgtttgatgaagcttatcttgatgtttcggctaaccatgcttttcccagtacgattgcgctcgcattgtggctacaggatcagattaaacaagccacccagctaacgagttcaattggcatttcatataataaatttattgctaaacaggcgtctgattataataagccggtggggcggaccctagtgttacccgaacaggcattgctgtttttggatcgtttgcctatcaagcagtttcggggcgtcggcaagaagacactaccaaaactgactgatcttggcgtcacaaacggcaaaacgttacgagcattgtcgcaggatcagttattaaccatgtttggaaaaatggggtttattttatatcaacatgcgcgtggtgttgataatcgaccagttgccgtacacaccgctaaatcgattggtaaggaacgaacatatggcacgccattaacggatgccacggcagttgagacccaattgcggaagctggcggcgatggtggtaactgctttgaatcagaagggaatgcatggcaaaacgttggtattgaaagtcagagacgttgactttgtgacccagacgaaacgattgactcaggaccattattttgagggtgaacaagccatttatacggcagcgtggcaactttggcaggaagttaaactgaccaagctagccattcgacttttagggattacggtcaccggacttgaccctaagcagtatgaaaatattgatttgccgttgtagtaaagcatgtgatatctaaaagtggtttctaaccgggctggctcacgctctgctgaaacgcgttcgccggcgcaggagtctgcgtgtaaggacctcgaacgcaatggccaaagcccggccatcacgcccgaggccacttacactccgactcctaagcacgccggttcacgctctgtattagtacactctcaccctatggtatactaacgatagattgcaatgaggtgatggtatggcgacaaagcatgagcagattttggattatattgcaaatttggcggttggtaagaaaatatcggtgcgttcaattgccaagcatttgaaggtgagtgaaggtactgcttatcgtgcgattaaggaagcggaaaatactggttttgtttcgacgattgcacgggttggtaccattcgaattgagcaaaaaccattaaatccaattgaatccgtgacgtttaaaaccttggttgatttgattgacgctaaagttttaggcgggcaggctggtatggacaaaaaactcgacaagtttgtgatcggggccatgacaccggctgctatgcgtccatacatcacgcgtaattcgttattaatcgttggtaaccgtgaagacgctcagcgattagcacttgaagacggagcagcggttctgattaccgggggctttgaaacaagttccgcgattattgcgcttgctgatgatcagcaattgccggttttacagacggcttatgatacatttacagttgcaaccatgattaaccgtgcgttgtctgatcaggcgattaagcaagacatcttaaccgttgccgctatttatacgcccctttcacaaatcgaaacgattggcgtggaggcaaccgttggcgattatctggcaatgacagatccccattatccgcttccggttgtaacgcgaaacggacgcttggtcggcttaatgcgtccggcactggcagctggcaagaaaccgactgtgccaatcgaacggctaatgcaaaaagatccgcaaactgtcaaaccatatttaagcgtgacgactgtgggccacacaatgcaggataatggcatgaacgcaatgccggttgttgatgacagttggaatcttttaggcatcgtcacgcgcaatgctgtcttttccagcttaaccgggattgcccatagtcgtgaactgaccaatacgattgctgaccaggtgagtgcacagttaacggctattaccccgcaaaagccatatggtggtgggtttgagctcaaaacagtgccggcgatgaccaatacgctggggacgatgagttttggcgtccttgctgaagccattaatagttgcacgactcgctacttgcatgataccgggcgccggaatgttttggttgagggcgttaacctgaccacttttcgaccggttcagttggagagtattgtgactgttttattgcgggtgcttgagctaacgagacacgatgcaactttggatgtggacgttctcagtgatggcgttcaggttgctaaggcagttgtgacttgtcagctattagaaaggaattgatcaaaaatgatccagaccgatattattaacgctattaaagccaataatccaattattattcatcgccacatcaatcctgatcctgatgcgctagggtcacaggtggggctggcagaaaccattcgtgccagttttccggataaacaggtttatcaagtcggcagcgatactggcaatttaagttggttggctgaagagcaaacaattaaggatgatgtttatcaaaatgcgttggtgattgtcaccgatactgctgatacgccgcgcatttcggatagtcggtttaatcaaggtaaaatgctcattaaaatcgaccatcaccccaacgatgatgcttacggcgatctcgtctgggtcgacaatcaggcgagttcagcttctgaattgatttatgatctcattgctgccagtgacggagctttaacgttgtccgacaaagcagcgcggttgctttatgccggaattgttggcgataccggcagatttttattcaacaatactaccccgcatacactgcaggttgctgctgaattaattaaaaaagacttcgatccgactgccattaacaatcggatgaataccgtgacgctggggcaggcgcgtttacagggctatgtcattgatcatttgaaaatcagtccggctggtgcggctagtgtgacggtaccgcgcacggcaattaatgacctgcatttagccgatgatcaggtaagcgcggttgtcggaactcccggtcggttagatacggtggttgcgtgggctgagttcattgaacaggcagaaggcggttatcgggttcacttacggtctaagggtccgattattaacggcctagccaaggaacataatggtggcggccatccactggcaagcggagccaaagcggccaattttgacgaaatcattcaaatcgaaacgcaacttgatcaattagttaaagacttttcaacaacaagaaagtaggcattatggacaatcaattcaaacaataccaactcaagccttttgtgattgccggccttgacgccatggggattacccagccgacgccgattcaaaaaaaggtgatcccggcgttgctgcgtggcgagaacctggtaggtcaaagccagactggtagtggtaaaacccatgcctttttggttccattgcttagcctggtagatccaaatgaagacgcgacccaagttgtgattacggcgccatcgcgggaacttgccaatcagatttacgcagttgcccaacagttgacgcaaaccgaaccggccattcgaattagtcgtttagtgggcgggatggacaagcaaaagcagattgacaaattgcaggcccatcaaccgcacgttgcgattggcacgcctggccgaattctggatatgatcaagcgctatgatcttgttccggcatcggttcgtcattttgtcgtggatgaagccgatatgactttagacatgggctttttggaaaccgtcgatgccattgcttcaagttttcccgaacatttgcagatggccgttttttccgcgacgattccgcaaaagctcgaaccgtttttgcgcaaatatatggatcatccgaccgtgattgaactcaagccgcaatcggtaattgccgataccgttgagaatattttaatcgcagttaaggggcgcgacaaaaacgagctgatttatcagttagtgacgatgggccatccgtttttggtgttgatttttgctaatacgaaaaccagtgtggatgccattcatgattatttgaaacatcagggactcaaggttgccaagattcatggcgggatccagcctcgagaacggcggcgaattatgaaggaagtcgctgaccttaagtatcagtatgtggttgccactgatttggcggcgcgggggattgatatcaaaggggtatcgatggtgattaatgccgagattccgcgcgatcaggagttcttcattcaccgggtcggacgtactggccgcaatggtttgccagggacagcgattacgttatatgagcccggccaggaagatcagattgctgaattggaacatatgggcatcaaatttaagcctaagaccattcaaaaaggtgagctggttgacacgtacgatcgtaatcgccgggttcagcgcaagcctaagcaagaggacacgagccttgccattcgcggcttggtgaaaaaagcgaaacaaaagcacatgccgaactatcgtaagaagatccggacagcagtgttattggaacgcaagcgcaatgccaaagttgcacggcgtcaagccttgctagccgagaaacgcaagcaccgtaaacgagggtgagaacatggccgtaaacgagttgacgttaccgacatggaatagcttggatgaaaaaagacaacgatttattttccaacagttgacccgctactttttgagtccgttactgacagttgatgagattcgaccggtgactgctactttttatgggcagacgttgcatacttttgaagccatgatcggcggcgaatgggtgcggttgattccggggatggcccaagtgagcttggggtttcatgcgcagcagcaagaacaactggcttcctacttgcaacaaagcggtttgaccgtaacggacttaacgcaggccttgtcgccgcaacgggaagtcgctatgccgcctatgctggttgcgactaaagccacgccagcaaacgaggagatcttagggcgcattagtttgacaactcgcattttcaagggtaatcacatgcgctatgctgcgattcgcgcgcaagtgttgcacctgttggatcggcaaggcagccttgatccttttgcccaaagcggttgggcggcgagcttgaccagtggcaacattaaattacgacttgccagcgctcatcattatcaagtgagcatcgtcaagtcctggcaaaaagcggatttgatcaagtcgctgagtttttttggctttcgattgccgactcaggatcagtatgaatatctgcaaagcggcggccggcaaagtctgtttgcgtttggcaataccttgccgccgcagttaccgcgttatttgccgaatccattcggtttgacgattccggttgaacgtgcgggtagtgaactgattgcggaagatattcaaaaaagtacagcgttgcccgcacagccatcagctaaagcagcgttagcattgtcgcctttttatcaggcagaaggtgccgatgacctgaccgttgccagttatcggcgggttgcaacagttacggttaattgagaagccagacgtcgggtgtcttgaaccatgacgaatagtcggttgtttttcaataacgagttgacccggttttttagaaaagctataattgggactcgttaggatatgtgtcgacccctgagtgagacagaaacagccgcatacgttgagagcggctgcaccgggctaagatatgctccctaatatcaggtgaacgaatattaatgaagtggtaatgactcgcatcattgcaaccaaggtggtaccgcgtgcaagcgcccttggcagcaatggtgctttttatgttgataagggtgtgcggcccacgttaacgcgtttgttggcgcagggatctgcgtgtaaggaccttagtcgcgatggccaagcccaggccatcccgcccgaggccgcttacactccgacttctaaccgcgccggctcgcgctcactttccataacgcgctccccagcgcagggatctgcgtataaggaccttggtcgcaatggccaaaacccggccatcacgcccaaggccacttatactccgatccctacccgcgctggctcgcgctcaccataacgcgctccccggcgcagaagtctgcgtgtaaggacctcagccgcaatggccaaagcccggccatcacgtctgaggccacttacactccgacttctacccgcgccggctcgcgctcactttcttttaggaggaaatttcatgaaaaaaatgtcaagtggcgagattcgccaaatgtttttggattttttcaagagtaaaggtcatgcagttgaacctagtgcttcgttgattccggttgatgatcccactttgttgtggattaactcaggcgttgcaactttaaagaagtattttgacgggtcggttattccagacaacccgcgtattaccaatgctcaaaagtcgattcggaccaatgatattgaaaatgtcgggaagacggctcgccatctgacattttttgaaatgctgggcaatttctcggttggcgattatttcaaaaaagaagtcattccgtgggcgtgggagttattgacgagccctaagtggtttgattttgatcctaagcgtttgtatgtcacagtttatcctaaagataaagttaccaaagaactttggcgcaaagttggggttgcggacgatcatatcgttgaggctgaggataatttctgggatatcggtgaaggtccatctggtccggattccgaaatcttttatgatcgtggccagtcctttaacaatgtggctgaggatgatccggaaaactatcctggtggcgagaattcacgttatgttgaaatttggaacatcgtcttttccgaactgaatcacttaccggatggccggtttgttgagcagccgcataagaacattgatactggcatggggcttgaacgtttagtcgcggttatccaaggcacgccaactatttttgaaactgatttattcatgccaattatcaaggcaaccgaaaaaatgagtgcaggcaagcgttacggggccaatgcgcaagatgatgtgtcctttaagattattgccgatcatgcgcggacggtaacctttgcgattggtgacggtgcactgccaagcaatgaaggccgcggctatgttttacggcggttgattcggcgggcggttttaaacggcaagaagctcggcatcaatcatgactttttgtatcaactcgtgccggttgtcggcgagattatgaagagctattatccacagattctggccaaccagccgtttattcaaaaagtcattgaatccgaagaagcccgcttccggcaaacgcttgacgccggggttaatctgttgaatcaaattattgctgaactgaagcaagacgggaaaaaagaaatttccggtgcggatgcatttaaattgtttgatacgtatggcttcccggttgaaatgacgaatgaatatgctgaagatgaaggcttgaaagtcgacatggccggcttcaaaaagaacatggctgcacagcgcgatcgggctcgcaaagcacggggtgatcggcagtcgatgggcagtcaagataccgttttgatggacattaccacgccaagtaagttcaccggatggaccgagttggatcataaacatgccacgttacaggcgattgttgtggatgatcagcttcaggatgaagtcagcaccgggcaagcccaactgatttttgacgaaacgcctttttatgccgaaatgggtggtcaggtcgctgatcacggggttattaaagctcaggatggcaccgtattggccgaagtgacggatgttcagcatgcacccaatggtcaaaacctgcataccgttaccgttaaaagcaaattgacgaagggacagccatattggctcagcgttgatcgtttgcggcgtcagaaagtttcacttaaccatacggccactcatttgctggatcaggcgttgcgggatgttttaggtgagcatacccatcaagccggttcgttagtcgagcctgattatttgcggtttgacttcactaatttcggtcaggtaacgccaaaacaactgcgcgaagttgaaacgattgttaatcagaagatctgggatgctttgccgattacgtggaaagagatgccaattgctgaagccaagaaacttggtgcgattgcgatgtttggggataaatacggtgatgtcgtgcggattgtttccatcggcgattataacaaggaatttgacggcggcacccacccaaccaataccaatgcgctaggtctgttcaagatcaccagcgaatccggcattggcgcaggggttcgccgggttgaagcagtcacgtccaaggaagcttatgaatatctgacccaacagcaggactggcttaaggaaacggctgatcatttgaaaatagatcaagtgaagaatgtgccaagcaaggtcacccaactccaagctgatctgaaaaccgaacagaaaacggtggcaggattgcaagctaagttggcagcccaagcagcagccggcatttttgaccgcgctgaaacagtaggcggatttaagctgattgccaagcaggttcaggtagccggaatgaatgaattacgacaacttgccgatgagtggaaaacaaagcaggcttcggacatattagtgttaggtaccgaagcaaatggcaaggcaaacttgttagtagcggccaatgccaatgctaatcaagccggtttgaaagcaggtgacctgatcaaggccattgcgccaaaagtaggcggcggtggcggtggtcgtccggatatggcccaagcaggcggtaagaagccagctggcattccgtcagcactggcagaagctaaaaacgtgattagccagcatgcataagcattgaatgcagtttttcttaaatcaaacaatggacatcaggagttaggatggcgttttgctgactgacttctggtgtttttgtttttgctgccatgaatacgggaagtcatggtagaattaagaaaacgatttcagcgaggtgagggagatgaaagcgttgcggttgggaatgacggattttttggggtcgcgtgaactgtatcgcgttgtccgtcaagccgatagcgttaaactgacatatacggttgatccatcaagtaccgaggggacaatcgaaaatgaattgactggcacagatgcggaggcgtttttcagccggttagcaacgtttgactttgcgtcttggcgagtacttggtgaaccgcagccgccactgcttgctgatacacggtggaaccttgcgataacggaagatgatgaacgggttttgcgatatgaaggcggacagccatttccggataggtttaatgagctactgagtttattaaaatataccgtgacggttccgggcggccattttttaccgccgatcgcatggcaactggattatgtgcgatttggtacgttacagttaccaaagtttgaaggcccaagacgattcttaagccggcagttacgctatcggcggacgtatttgattgaagccaacgagaaccgggttgtgttgcgcacccagtatgctgaaccgcttagtgatcatgatgtggtctatcatgatcccaaattagtcgcggcactcgcttcaaaagtggcagctgcagttgctgaattgggtgaagtcgctgacctgtcaattgattcaacgtggcaaccacggtctgtactggctttgacgattcaatatccccacggtgagccaacgcgtattcaggtggatgccgagttgaatcggaccatgaaaatgctatggcagaccgtcacagaagcaattcaggcatttcagcgcagcagtgaacaccgagatcagcaagatgccattcagcttgggccgcaattgatgcactatatcaaggtgaatttccgccacggggtcaaagactatctgtacaaaacggatatccccagtttgcaggaaggcgatctagttctcgttccggtgggcaatgaaggtcgcacgttacatgctgaagttacgaatccgtatgtgatgccgccaattcactttccggtaccccctgataaaatcaaacaggtgatcggattggctgacttggatgatgatgaagacgaagacgattggtgttaaagcgcatcgtccaaaaacatcacttacttttgctcaggaattgtacatttgcattgatttcaagtaaaatggtctgtgaagcggatagaatagaggtgtaagaatgagcacattagatcaaaccgttcactttgattttcgcgataacaatcctaaaaatgttcacgagacgttggaaactgtttataaagcactagaggaaaaaggatataatccgattaatcagatcgtggggtatctgatttccggggatccagcgtatattccgcgttataacgacgcgcgtaacctgatccggaaacatgagcgagacgagatcattgaagagcttgttcgaaactatcttggcaaggagcaagcttaatgcgcttgatggggttggacgtcggttcccgaactgtgggggttgcggtcagtgatcctttggggtggactgctcaaggattagagatcatccgaatcaatgaggataagcagcagtttggactcaaacggctcaaagaattggtgacccaatatgaggtgacggcatttgtcttgggattacccaagaatatgaacaattcaattggaccgcgcgcagagaaatcacaagcatatggtgatttacttaaagagacgtttgggctgccagttgatttcatcgatgagcgattgacaacggttgaagcttcgcgaatgttaattgaagaagcagatgccagccgtaagcggcaaaaacaagtgatcgacaaactggcagcgcaaatgattttgcagaattatctggatgcaaaaggtcccttgaccaggcaataactctggctgcggccgtgcgcccctgccagaattgaaggagaacaagatggcaaataatgaacatgtcaaacccggtgacgacaatcagcagattaccctgattgacgaaaagggtaatgaagagttatatcaggttttgtttacatttgattctgaagattatggtaagagctacgtactgttgtatcctgccagtgaagatgatgatcaggaagtcgaaattcaggctttctcgttcacacctgatgcaaacggtgatgccagttcgggggatcttttcccaatcgaagatgataaggaatgggacatggtcgaagaagtgttgaatacttttttggctgatgacgattcgaatctacaagattaatgacgtcatgaacccatcaggccaccagtattttggtggcctttttgtggcaatgccaaaatgccccagtatgggtggtccaaagaaggaacgaatagagtagaaacgaaggaaagttggcgcataccgaagcacttctgctcgcactttaccagttatggtagaatacactttgaaagagtggaggcattcacgccatgagtgaagagaagcgtcgttttaaggccgttatcggtgataaagcgtatacgattatcggtcccggatccgaacagcactttttgacggtcacgaagctgttgaatgaacggcttgatcaagtcaaaaaacttgcgccggatctgactgccgaggaacaggcgattttagttgccttcaatgctgtttctgatcaagttaaattgctggcagcccagcaggatcattctgatcagaaagcataatgggggaacgttttgatttcaattacgattattttagttttggcctatttctattatagcggggctcgccgtggtgcagccttacagtggttgcatgtgggtggttatgccttgagttttttagccgcaacggcactagcccgacctttgggagaacactttacgttgttgatcccttacccctctgcgacgaatgcaggacagtttgccttttattccgataaaatcggcttgacgctggatgatgcattttatcgcggatttgcttttttagtggtgctcacgatcggctggttgttgacgcggattgcggccttgtggttccacgacttgacgtataaagcaatggcgcacaaaaagagtgcattaataggcggctgggccaatttagcgatagggtatatttttttatttctcattttgtcattattggcattgattcccatcaccggcattcaacatgggcttgatcactcgcttgttgccaaaatgatgattaaatactcacctgggctgacacagtttgtgaatgccctttggttatgaacatgatgacgctcaaggacggataactgacgtctttgggcgcttcttgattatgggagcaatttaaatgaacacgaagattttaagaacacttgagtacgacaaaattcaacaggccttactgcgccaagtggtaacggcaaatggacagaaaatggtccaaaacatgaccccgcaaacagatcccgaaaaggttcagcgagcattagacgaaaccgcagatggagcttcggcattgcgacttaagggcggcattccggttccacagttggaaaatattgacccagcgctaaaacgggttgatattggcgccgtgctaaatggtcaggagttggccagtatcagtcgggttctgcaaacagtcagtgcaattgataaattcttaacggatttgcaagaccagattgactttcgccagttgtattcactgcaggccgagctgaccgtgctgccacaactatcaaggcggttaaagacagctgtggatcctgaagggacgctaacggatgaagctagtccggagctgcatggtattcgcgaacagattaagcgaatcgaaggagatattcgcggcaaaatgtccgaatatactcgcggagcgcagtccaaatatttaagcgatccgattgtgaccattcgtgatgatcgctacgttattccggtaaaagcagcttatcgtgccaagtttggcggggtcgttcacgatcagagtgccaccggacagacgctttttgttgagcctcaggcaatcgttgcgctgaataatcgcctacgtgaggcacaaatggccgaaacagccgaaattaatcgcgttttggctgaactgtcgaatgaattggcgccgtataccggccaaattaaggctaatgcggcggttttgggacattttgattttattaacgccaaagccaagctggcaaaagcccaaaaggcaaccgagccactcgtatcagctgaaaatgatgtcctgctgcgccatgcccgccatccgctcatcgatccccatcaggtggttggcaatgacatcccgcttggcgctgattatcaagccatggtgattaccggccccaacaccggcgggaagacgatcacgttaaaaacgctgggattgctgcagttaatggggcaatcgggcctattcatcccggctgacgatgagagtcggatcgggatctttgatgaagtttttgctgatattggcgatgagcagtcgattgaacagaacttatcgacgttttctgcccacatggataacattgtccatattcttaagcagctttcgcaaaacagtctcgtcttgtttgacgaactaggcgccggcacggatccgcaagaaggggcagcgttggcgattgcgattttggacgcggtgggtgaagtcggcgcgtatgtggtggcaacgactcattatccggaattaaagctctatggttacaacactccgaagaccatcaatgcctcaatggagtttgacagtcaaacccttcaaccgacttatcgcctgttggtaggcgttccggggcgctcgaacgcctttgacatttcgttacggttggggttgccccacacaattgttgaccgtgccaagtcgatgatcggatccgatagtcatgaacttaacgacatgattagcgatttggaaaaacagcgtaaggccgccgaaactgctcgcgcttctgcacagcggcaattagcagcagctcaggcacttcatgatgaattggcgagcgcatatcacacgtttaccaccgagcgcgatgctcagctacaccaggccaaagaaaaggcgaatgcgctagttgacaaagcacagaaaaaagcggataaaattattaagcagctgcggcaaatgcaactgaccaatccgggtaccgtcaaagaaaatcagttaatcgcagccaaaaccgatctaaaacggttgcatcaagatgaaccgctgcagaagaaccgcgtgttgcggcgagaacgcgaaaagcaggcgttgcatgttggtgatgaggttaaagttgccagctatgatcaaaccgggaccttgttacaacaatttgatgagcatcattggcaggtacagttgggaattttgaaaatgaaagtcccgacaaccgagcttgaaaagatcaaaccatctaagcaggcagccaagcagcggccggtcgtcaaagtcagtggcggtggcatgagcggcccttcaacaaccttggatctacgcggcgaacgctacgatcaggccatggctgacttagaccagtatattgacgcagcactgttagccgggtacccatccgtcacaattattcacggtttaggcaccggtgcgatccgcaatggggttacccaatatctgaaacgtcatcgccaagtcaaaagctttggatttgccccgcaaaatgctggcggctccggagcgacgattgttaatttcaagtagttggctagttttttgccggtagatgtgctatgatttagttacaaaaagtaagaggaggaatccgttcatggttcaagcagttacagattcaaactacaagacggagaccgacactggcgtcaccctcactgatttttgggcgacttggtgcggcccttgtcggatgcagagtccagtgatcgacaaattagccgaaagtcgcgatgacgtcaagtttgttaagatggatgtcgatgctaatccggagacacctaaatcattcgggattatggcgatcccaacgctggtcatcaaaaaagatggcaaggtcgttgaaaagctggtcggttatcaaaccaaggatcaattagaagcaaccttaaacaagtacaccgcttaattgaatttgtgatccagacacactgattgaatggtcagtgtgtttttttgaccattttttcggggacgccagaatcaagaaaacaaaaaaatatcccaaaattctgatttcatctaaaacgagggaaaacaatatcttttttagctttaagcggatatatttaagctatttcgatggcccgtcaccgaatttttcaggcaaaaagtaccggctgaatttgcgctgattcgagtctgaaaaaatgccgccgatgcctagtgtttcgggactttgaacggttatctaactggcctgtttgattcacattacgaaactgttaggtgattgttacgcttttcgttggcgaggctttttctgtaaaactataatggatgtgtcaataagaacgtggggtgacaagatgttcacaaaattaaaagcggtgtgggaaaatcccacatttcggttcatcttttggaccgtcacgtatttcgtgatactgctggtcctggtttatctatatggttacagcggtattaacaacagtaaattcatttataacgagttttaaagggggaaaccgcgatgatcgataatgttattacagcgattgatcgggtcgccgcagagcatccaacgcgcgtggcttatgattatgaaggtacccaatatacctacgcgcagttgaaagaaggcagtgaccgcctagctggattctttgcggaatcattgccggctggtgaacccatcatcgtctatggtggtcaaacctttgacatggttgaggttttccttggactttctaaatcagggcatgcctacattccgatcgacacgcatagtccaaatgaacggattacccaggtgcaagatgttgcccacgcgcctgctgtgattgaggtggcaccgcttccgattacggttccggatgtcaagattattcaggcgccggagttacatcaagctgagcagtcacacgcgccaattcattcactgcagcatgcggttgctggcgatgataattactacatcatctttacaagcggcacaacggggaaaccaaaaggcgttcagattagtcacgataaccttttgagctatgtgaattggaatatttccgactttgggcttgaagaaggcgttgtcgccatgtctcagccgccgtattcctttgacctaagcgtgatggatctttatccgaccttggttttaggtggcaccttgaaggctttaccaaaagaagtcaccgataactttaaagaattatttgcgacgttgccaaaattgggcttgaacgaatgggtatcaaccccttcttttgtcgaaattgcgttacttgatccgaatttcaagcaggaaaattatccgaacctgacccattttctgttttgcggtgaggagctagttaacaaaaccgcccaagcgctgatcacacgtttcccgaaagcaaccgtctataacacgtatggtccgaccgaagccaccgttgcggttacgggaatggcgattacccaggcgattgttgatcaatatccgcggttaccgattggctatgcaaagcctgataccaacgtttatgtggttgatgagcaaggtgaacaggtttccgctggcacggaaggcgaattgatgatcgtgggtccaagcgtgtcgaaagggtatctcaataatccggacaaaacagccgcggcatttttcaaggctggcaatcaacgcggttatcggtctggtgacttagtgaccatgaccgcagatgggatggtcttttatcgcggtcggaccgatttccaggttaagttgcatggttatcgcattgagctagaagatgttgatcacaatttgaatcaggtttcttatattaagcaggcgtcaacggttccgcggtatgacaaggatcataaagttgcccagttgattgcctttgcggttgccaaaccaaatgactttgatagcgaaatgaaactaacgcaggcaattaaagccgaactagggaaaatggtgatggaatatatgattccccaacggattatttaccgggatcagttaccattaacggctaatggcaaggttgatcgcaaagcactgattgcagaggtaaatcattaatgcttaatttacaaccgtatgagaatccacagtattttgtctatttaatcattgccttgcttcccgtcatcatcggcatgttcaaaggctttcggatgcattggtatgaaagcatcttttcgttggttttcctggtactgatttttgacgccgataaatggcctcaaggaaaagcattattgggctatgtggttttcaacttgttactggtttacgcgtatttcaaatatcgaacgcgcgaaggctcaaaaaattccacggcagtcttttatctgagtgtcgcgttgggaattgcgcagctggcagttgtcaagtttacgccgctgtttcaacatcatggttccattctgggctttctcggcattagttatttaactttccgagtggtcggcacgattatggaaattcgtgatggatcgattaaagacctgaacatgtggaagtttatccaatttctgctattcttcccaaccatctcaagtggcccgattgatcggtatcggcgatttgtcaaagattacgatcgcgttcctgatcccgagcattacgcccagttggtgaccaaagcgattcactatctgatgcttggttttctgtacaagtttattctggggtatatctttggaaccttgtggctgccttctgttgaacacatggcgatggccagtcgcggtggggctttcttgggactcagttggccagtcgtgggcgtcatgtatgcttactccggttatttgttctttgattttgccggttacagtttgttcgcggttgccatttcctacttgatgggcatcgaaacaccgatgaactttaataagccttggatgtcatataacatcaaagacttctggaatcgttggcatatgagtttgagcttttggttccgtgattatatctatatgcgctttgtgttctttatgatgaaacacaagtggattaaatcgcgggtctggacggcatttgtcggttacctcgttttattcctgattatggggatttggcatggtgagacctggtattacattgtctatgggctgttccatgcgatgctcattaatctgacggatgcatggctgcggttcaagaaaaagcataaggactttttcccgcataaccgcgcaacgcactacttcgccattttcatgaccgctaatgctgtatgcttctcgtttttgattttctccggtttcttagacaagctgtggttccactaaaagaatgttgttgtaggcggtcaatcgcttgaagattggctagggtttaaaagaaagaggtaattcatcatggcagacgaagcaattaaaaatggtgttttggatattttggcagatttaacaggttcggatgatgtgaaaaagaacttggatctgaacttatttgaaaccggactccttgattcaatgggaacggttcagttgctattggaactacagagtcagtttggcgttgacgcaccggtttcagaatttgatcgtaaagaatgggatacaccaaataaaatcattgcaaaggtcgaacaagcacaatgaaaaaaccgatcgggaagatcctttggcgcggacttggcccgttgctgatcgctatcatcctggtcgctgcgttgatgctcgtgccatttaagtttggccgcagcagccaagcaacgatcaggcaggcggccagctccatgtcggccaacgtgctgaaaggcgaaactataaaaaacgaggccatggccgaaaactatgtcccgttcattgggtcatccgaattgtcgcggatggacgcatttcacccttccgtgttggctcagaagtatcatcgtgattatcgcccatttctcatgggaatggcgggaacgcaatcactcacgcacttcttgtccatcaatgccttgacgcatgttgaaggcaagaaggcagtgatggtgctgtccccacaatggtttgtaccaggcggtgttcgcaaagcccagtttgattatttctattcgccggcacagatgacaaccttcttacttcatgctaacccgaattcggaagcggatcgctttgcagccagacggttacttcaatttccgtccaccgattctgatcggaccgtcaatgaagcactgaagaatattgctgccggtcagaaactgtcagatggccagtattggtatttgaagcaggtcaaggatccaatggctgatcatcaggatgcgttgttttcacggctatttttaaataataaccaaccgcaacttgataaggctgccaagacattgccaagtacttacgatgttgatgatctagatggattggcaacgcggatggggatgcaggagacgaccaataacccatttgaattgaagaatgatttctacacaaagcgggttaagcggaacatgccgaaattaaaggggtcgcaggcaacttggagttatgttaagtcgcctgagtattcagacttacaattggtgctgaatacgttcgccaagaagcatatggaagtgctctttgttatcccgccgatcaatgcaaaatgggcggccttcaccgggctggatctaggcatgattcaaaacacggtcaccaaaatgaagtatcagctgcaaacacaaggctttaatcacgttttggatttgagtcaggatggggcacagccttacttcatggaagataccattcatattggctggcgcggctggctgaagatggatcaaacggtgcggccatttttgaagacaaccaaagcagctcccgttcattacaagctcaatgatcagttttataccaaacactggcaacagcaatcggccaatgggttagattagaggccagtcagctttaggtgtcctagcattatgtagtaaaaagtgaaccaagcataaaaaacgaagggcaaacgaatttctcccatgtcgggaaaatccatttgcccttcgtttattttctgtatgcaagttgactcagctttgatcgcttgcaagatcaattaaatgtttggcggtgggttgcgcatctttattgtccatcacaacagtcagaacaacattttgctcgcggcgctgaatggcactgcctccttcgactgcaaagccaaatacctgctgcagcgcttgcgctaaaaagccggcttcgagttgaaagtcgggatcgtcataggtacgaatccgagtcgcgacaacatctcctgcaagcagatattggcgctcttgccgtttctgtttaagtggcgacaaagttcccagaccaacctgggtgaatagctgtggtaaggcagattccgcgacaggtaatttggttgccaagtcacgtccagcccaatagagaatatggtgctgttcttcaccaagcatatttggcagcataagatcgcgcattgccgtgattgcaaagaatgaaaccgagccgggaaggttcagcagggtggtataatcagattttgccatgttgtgcctcctgtttctattcgtctagtatagccgaaaaatggattgataacatacttttctgagtgcttgcattttttttggattaaactcacaataaagactcggagctttatagcggtggccagcacgataagggatcgacggctgcgttccttttcgagggacagggttgatgttggaaataccacgggatgggttggcgtgaaagaaggggccggcagcggcttttctggacacggcgaccactaatcggcggtcttgccgtcatcaagtgattcaaaaggagaattatgatgaacaagcaaccaatcggatttattgattcaggtgtcggcggcttaacggttgtgaaagaagcgctccatcagctaccagccgaaaacaccatttatttaggggatcaggcacgcttgccatatggaccgcggccagctgagcaggttcaggcatttacttggcagatggtcaactttttactcaccaagcatatcaaaatgctggtaattgcgtgcaatacggcaacggcggcagcattaccgttaatcaaggccagattgaagatcccggtcatcggggtgatcaagcctggtagccgagcagcgttaaaggctacccagaccggccatattggtattattgctacggaaggtaccgtcaaaagcggggcgtatcctaaagctttacgagccaaagcacccgacattcgcctcacgagtctggccgcgcccaagtttgtgtcgttggtggaaagtaacgaagcgcactcaccgattgccaagcgtgtggtagcggacaccttgcagccgcttttacatcaagatattgatacactggtgttaggttgtacgcattatccgattttgcggccgattattcagaatgtgatgggtgaagacgtcacgttaattgattctggtgctgaaaccgttaatgatgtttcgatgttgctcgactattttgacttagccaacgatggtagcgaggtgccaacgcatacgtattatacgaccggcgcaccatcaatgtttgacgaattgggggaatcatggttggaactaaaaaaaccgatgcacgcacagcatgttgacattgatacacaaccaacgcattttgtagagccgacttctgaggcgactgataaaaccattgtcattgccagcaagaaccccggcaagataaaagaatttaaagcgatgtttgagccagcaggggtaaccgttaaaagtttggctgattttcctactgtgcccacggtggatgaaaccgggaccacttttgaagcaaatgcccgccaaaaagctgatcagtatgcacaggatttaaatttgccggtgcttgccgatgactcagggttgatggttgatgccttggacggacaaccgggaatccgttcggcgcgctatgccggtgacggtcacaatgacgcggcaaataacgccaaactgctggctgctttggccgatgttcctgaagaagcgcgaacggcaacgtttcatacgacgctggtattagccaagcccaatcaccctgaagccgatttggtggttcatggcgatctatccggacgcatcacggcgatcccccgtggaacagacgggtttgggtacgatccttttttcctggtgccggcgttagataaaacgttagccgaactgactgcagatgaaaagaatgaaattagtcatcgtggtaatgcaatgcgcgcattggagaaggtttggcaggcatggttggaggaaaatgtatgaagattttggcagtgagtgacgcacatggcgaccgcgatattttggcggctattttgaagcaacagccgaatctagatggttatttttatgcgggagattcggaattacctgcaaacgatccgctttttaaaacttatcgtgcagtcgcaggtaatatggattttgatccggattttcccatgaccgtcacagcaactattgataacaccacgatttttatgacacacggacatcgtttcggggtgaactttggactggataagctggtggcagcgggggaagcagcccacgcacggcttgtgatttttggtcacacccatcagttgggtgttgaagaacatgccgggatgattgtgttgaatccaggctctattagccagccgcgagggcaattcgccaatctcggcggcacatatgccacggttacttttacatccgatcagattcacgttgatttcttgaagcgtgatggcagtatcgttgcaccgttaagccgtgattttttgcaatcatcacactgattacggaaacattgtggcagcgggataggcgagtatagaaaaacggtcccaattacggaaccgttttttatatggtcatctttaatttgaggttaaagaaataagagcttatacgttaaaacagctaggatagcagcggcgatgggtgctacaaccgggacccaagcgtaaccccaatcggagctgcctttgtgttttagtggcaacagtgcatgcaagatacgcggtcccagatcacgggccgggtttaatgccggtccggttgggccacccaaagatgccaccagcgttgccacgagaaatcctaaacccatgtgtgcagtgccaaggttgttctggaagaaaggtgccttagtaatacctagagcgccaatgaaaagaatgtaagaaccgataaattcattaacaaaaccattcagcttactcttggtggcactaatcgtactgaaagttccaagaatatgctgtgtattggtggtgagatcataatgcggtttatacgcggcaacgacaagcagctggcctaccattgctcctgccatctgaacggcaatatatggtagcacctcggaccaagggaacatgcctgatgctgctaatcctagggtaaaggcggggttgatgtggttaccggagatggcgccaaacatcatggcagggatcatcaccccggcaccatacccaacggcgatcaacagccaatcggagccatttcctttggtacctttcaaatcaacgttggcaacggaaccgttccctaacagaaccataacggcggtcccaataaattcagcggctaaccgcactcctaaatcatatgtcatttttttcctccaaattagtcaaagatcattaaagtttcagtagagcttatacaagtataattattgctcaagatagtgtatcaatttttataaataccgtccattgaaattcccttggagagcgcgttatagacagctcatggtaaaataatatgaggtgtttatccgtcttttggcggatggcacttaccttaatgagcgttaagatgctttaaagaaggttacttagctcaacataatttcgctttttcagctagaatagcaatatcaaaaaggagctagtcatatgttaaatcaggtcattgccaacatgctggttgaaaatcggcatcactttatgatcgctgcggatatggtggcaacggtttcggagaataatcccttgagtcacgcctttcttgtgcttacaaaggttagatatgcaaagattcccgtgttggatcatgattcgaagttcaaaggactcatctcactacctatgattaccgacacgatgctggggctggaccatatcagttttcaatctttggacaccatgacggttaaagacgtgatgcaaaaggatgtcgccacgattaacgacccatatgatttggagactgtgttacatttgctggtcgataatccgtttattccagtcgttcaggatggctactttacgggaattgtgacgcgacgtgaagtgatgaaaggcatcaataacattggccataacatcgacaaacagtttcaattggaaccggtcgcaccggtaacggagaaagaatcttaattgattaaaaccagcaaagcaaatgaatgcgtgctggtttttttgctgtcatcaggcatcccgatcgctttccggtttatccaaaaagacagttgccaaaaccccaatcgtgagactgacaagaacggccaatacagcagccagcatacctgtagttggccaataaggcgcaatccccgtttcaatcaggatcaccaccgccgcggcgacaatgccacaaaccgcgtaataaacctcaacctcaaaatgttctagtaaataacccattagtttggcaatggcaatgagcccgatcaacgcacctaccataaaaggtaccagtaaggcgacagatcccatcgcggacgtaaacccggcccaattaccggcaaccaaggcccgagcagcatcacctaactgactgacagcatggtaaaccgtgccatattgatcaatcaccatgagcatgaccgatccggaaatcccgggaatcgccattaatgatacggcaaagatacctgaaaaacccatgattgcggcatcccgcacgctcgatagtcgttgaatggcgatcaggttctccggttgggtgccgccaagcttggctaatccataaatcgcaataaatccaccaagcatcaacaaaagataccaccatgaaaacggcttaagaaccagcttgcgataaatgaacggtccgatccccagtaccaagccgatgaaaaaaccgtaactcggtaatggccagtgagtcgtgataaccagaaccgccttagtagacaaaaggatcccgacaattgcgcctaagccaaccggggtcagaaagcgtaaatttttgcgcggattggcgcgaaagtgattaagtgcatttaagaggcgatcataaagcccaaccacaaccgcaaagatactgccggaaagtccgggaatgacaagtgcaatgccgataatggcacctttgataaaattaagcatgacatctccttatagatggatttattaatagacaaacacggataaggtcgatcatgaacctgcttgcagattcagcggcggtgtaatgacatgaatgccggcagatttcaatgcggcaatgtaggcagccaggaaagttcgtttgaggctgacttgttcaccattttcggcgtagaacagaacctgataggtaaaagttccgtttttttcttcagtcaggccaaggatatccggcccatccgtaatagttgagaatttcggtaccagattgtgattgacatgttcaatcgtgcggcggaccaaatcaagatcggtcgttggggctaacggcaatttgataagtacctgcatgttgctgcgggaaaggttgctgacaatcgtaatgttgcgattaggaataaagttaaccgtaccatcgtagctttttaccacagttgtgcgtaatcctaggctagtgacggttccggaaatcgttcctagtttaaccacatcaccgacatcaaactgggcttctaacaaaatgaagaaaccagttacgacatcattgacgaagccctgagcgccaaagccgatcgccaacccggcaacaccagccccagcgagcaacgtgcccacaggaacgcctaatgttgagaggatcgcgtaaaaataaaagaagagaacaaagtagaaaaaaagatttttggacaacgcgtggatagttttgacgcgtgttcctgataacttggcgcgatgttggtaacttttaaaggtgcgattgatggcaaattggcctaagcggtagagcgcaagaaacagaattgagaagaatagcaacgagagcactttatcaatcaaagttccggcaatctggtcccaattaattttcgtaaagtaccttaaccagacattggattgtccagtcacggtcgcggttgtgaagatcatgcgaatcacgtgatggcctcctttgtattagcctcattttatcagaatcagggctagcttgctggggatttgccgcgtgtgaggcaatttttaatgttaggtagggttgtgaaggaagtgtgaggacggatggtttcaatatgtggttgtaagtgcagaaagctacgtctgaaatcggcttaggatctgaaacgcgtttacgggatcgaaaatctggaaatctgcatgtaaggaccttggatgtattgaccacaacccagtcaccacgctcaaggccacttatattctggtttacgcccataacgcgctccccggcgcagaagtctgcgtgtaaggaccttaagcgcaatggccaagtgcgggccatcacgcttaaggccacttacactccgacttctaaccgcgccggttcgcgctcacgctctgaaacgcgttcgccagcccagaaacctgcgtgtaaggaccttgagactaaatggccatagcccagccatttagtctcaaggccacttatattctggtttacgcccataacgcgctccccggcgcagaagtctgcgtgtaaggaccttaagcgcaatggccaaagcccggccatcacgcttaaggccacttacactccgacttctaaccgcgccggctcgcgctcacgctttttaaatcttttgcacgcgtgttgtgacgatgttatgattaatgtaaccaactggtttgaaataggagggtgttggatgtcaggtggagagattgcttggattattgcggcaacggcttttttgattattgctttggcgattgccatcattgctgttcgcgtttctggcgtaaccaaagaagttaaagaaaccgttgctgagacgaataagacgttggatacgatcaacggggagcttggcattttgacgaaagaagttgaaggcctacttgccaagagcaatacccttcttgaagatgtaaatggcaaggtggcggcgattgatccggtctttaccgcgattggtgaacttggcgaaagtgtttcggacttgaaccagtcaacgcgtcagctcactcagcgggtcacgaatggtgcaaaaaacggggctaaggcaacggttgctgcacgaatgggtgccaaagcattttcaatgttgaccaaaaagaaacatcaaaatgaatagcagggggaaacataatggctaaaaaaggacattttttgcttggatttgtatttggagctgctagcgccttggcaacgacttatttattgacaccgcaaaccagtgatgagttgaagcggcgggttaagcatgcgtctgagaaccttgctgatcgcgcggttgattatttcgattacgccaaagaagcaagtgctgattggaaacagagtgcaacggatttcgtagatgagatcaagacgcgcggtaacgatgctgacgggtcacaagccttggctaattatgatgctgcaaccgaacaattacgcgatcagctgaacacggctaatgataccgatacttcagcagattttgatgacatcgttcttgatggtaaaagtgcgtttgcgcaggcgaaagacgatgatgagggtagtgaaacccgcaccgatgaagtgcctgaaccgacaaaaccggtcacgattaaagaggcaccagcagattcggcagcggcagattctcaagcagcagataagtaattatcagctttttgatgattaaagatggcggcaaacgaaaggtaactccgtgtgagtacccttcgcttgtcgcttttcacatcgtaacggtcaaggcgagccgaattggctattttggttagaaattgagggagtaacatgttaaacagtgaacgtcaggcgcatatcaaggctgcattgagtacggcagctgaaccgctcagtgcatcgagttttgcacgccgatttacggtcagtcgccaaacgatcgtcggggatattgcactattacgggcacaaggcgaacccattattgccaccccaagaggctatacgttatcgcaaccagctgcacttgaatttttggttccatgtaagcatacccccgcccaaaccgagcaggagcttcaattgattcttgataacggtggctggattgaagatgtgttggttgagcatccgttgtatggccagttacgcgggcaattgaatattcgtaccgttgccgacatgaaactgttcttgagtcgggtcgcgcggtatcatggccatcttttatcagaattaacgggcggtattcatttgcacaccattagtgtcaagcagaaaagcgacattgcgaagattaaaatggcgcttcatcaggccggcatcttatatgagcagctggaggaagcagcggatcagggataaatagtttagtatctgagcttttaggctgaaagaaattggtgagtgaatctaaaaaaggttctagcaatgactgagcttgtcattgttagaaccttttttactagattgacatgtaacccacgatttcaaaagagcaacaattaacgtcacaagttaaccattaatgaccgtgaattcctttgatgtgtgcgtaaatggttcgcagccggtttccgtgacgtggacacagtcttcaatgcggacccccgccactcccggaacatagataccgggttcgatggagaagcacatgccgggctgcaagatcatatcattgccttccatgatggacgggaattcgtgcgtcgacataccgatgccgtggccgagccgatgattgaagtactcgccatagcccgctttagtaatgatatcacgcgcaattttgtccagttcggatgctttaagtcctggcttaacagcgtccatcgcggttaagttagcctcaagacagatgtcaaaaatttcccgtggcttaccagtgacttgaccaaaagcaactgtgcgggtcgcatcggacatatacccatgattgtcggtgcccagatcgaacaaaaccaattcgttaggtgcgagttttgttcccatcggttcgccatgcgggttggcagcatcgacaccagcttggacaatggtgccgaagctcatgtgcatgacgccttctttcatcatggcataatcgatttcagcggcgacttcttgttcggttgctccggctttaatggcattgaatcctgcctgaaatgcccggtcggcttgagcaccagcagcttccatctgtttgatctctgaagcggttttgatcaggcgctgtttttcaataaaacgagaagcatcaatcgggaaggtagcgtcggggaactgcttcatgatcgcttcaaatttgaaaacggcgagattatctttttcgattgcccattttgtcggattggggttgacggctttaatatgactcgccagttttgcaaacgggtcctcgtgatcaagataaccgaataccgggtaggcccagccggcttttttgacttcttcgatggtcagttgcggggtaaacaagaagggatcgtgatctggagcgacaattaaagccgtaatccgttcttctggatcttggaagaatccggtgtagtagttgatgttgatcgggtcgctaatgtaagcaagatcaaggccttcttcaccgatccaagtctgtaatgctgctaaatgttcgttcatgattttcctcctcaaaggacaaatgcaaaagtaaacgtcaaaatgacatacctgattaaacagccactgggtaagtcaatttcttgacgattcatcatgtcctgtggtgtgttgaaaacagttggttcaggctactccttaaaactcgctgctggcggcttagcaagcaacataaacgcaactttacccatcagtataacacggagaaaatgctaaaactttctgaaaagcctatttgtgaaaatttcatggaaaaatcagtaaaacgcttgcattgccgttctggttctgttattttggaatgtaaatagaggtttcgtgaattttcattttcacgactaaggagaaaataaagtggaaaaacaaacaattacaatttatgatgttgcccgcgaagcaaatgtgtccatggcaacggtgtcacgagtcgttaacggcaatccaaatgttaagccggctacgcgtaaaaaggttttggaagtcattgagcgccttgactatcgaccaaatgcagttgcccgcggcttggctagtaagaaaaccaccactgtcggcgttatcattcccgatgtgaccaacatgttcttttcgagtctggcgcgggggattgacgatgttgccaccatgtacaaatacaacatcattctggccaattcggatgagaataaccaaaaggaagtctcggttctgaacaccttactggcgaaacaagtcgatggtttgatctttatggggcacgagttgacagatgcgattcgcgccgagttttcacgcagcaaaacaccggttgttttggccgggtcaattgatcctgacgaacaggtaggcagcgtcaatattgattacgtggctgcggttgaagaggcgaccagacagttgattgaaagcggcaataagcgcgtcgccttggcaaccggttcattgacacatccgatcaatggtcaatttcgcttgaaaggctacaagcaggcacttgaaaaagcgggtgttgcttacgatgaaagcctgatttttgaaaatgaaccaagttatcaggctgggttggccttattcggtaagttgcaaaaggttggcgcaacagctgtcattgccggcgatgacgaattggcggttggcattttggatggtgcgctggacaaaggcgttaaggttccagaagacttcgaaattatttccagtaacaatacgaagctgacggaaatgacacggccacagttgacctccattgatcaaccattgtatgacattggtgcggtggcgatgcgcttgctcaccaagatgatgaataaagaagaaatcgaagaaaagaccgttatgctaggttttgatattctgaagcgtggttcaaccaagtagacagaagtaacacgatattctggcggcatgccaagcaagcatagacgataaaaagcagatgaatcagcgcatatatggcgcggttcatctgctttttggtttgttggtatgataaagatcaatgctgccatccgcacattgcttagacggtagttaatcagttaatggccggtacctgtattagttgacggggtttgcggagtagtcgtggtaccgcctgttgtcggtgcagaactggtggtggctgcttcagtgcctgtaccgccaccggttgtgccattgttgccgccagtaccggtagtttgcggctcactcggttgattttccgaagtgccttgttggttttgctgacttgatggtacggtcacgctaggtgtgcgactgctagaagctgctgctgatgaaggggtttctgtcgtaatcggcgtttcctgatgttcttttttagcctcggtggagcggccgttagcatctgacacttggccataaccattgcttttaccatcaagataatcgtagaacagctgataattatctttactgccgccaattgcaaactcggccttggcagttggctcccagtcattataaaggctggtcacagttgagccgccagtacggtaggtgtgtccgttaaacgaaagacttgcagccggctgaccggtttgtttatcaacggtgacggatttgacggtgctcggtcgacttagtttcttatccgctttgaattttttaggaatggtatgatacaccgcattggccagttttgcccaatatgcttcgttggtcatcgagctattttccgtgagggtatagttcgtgccattactattatcgtaccccatccagctggcaatcgtgatgcccggggttgagccgatgaaccaaatatcgcgaaaatcgttactggtcccggttttaccaatcagattatcggtattaaatcgcaactgatagttcaggctttccgcagttccggatgcaaccacgtttttgagcatctggttcataatgtagttggtgcctttagagaaaaccttggtctttttgacttgatgacgataaacggcatggcctgagggatcgacaatttcggaaatgacgtaggcgggaacatgttcaccttgattggcgaatgttgaaaaggcgctggcttgctccttaacgtcgaccccgtaatcagtacccccaagtgccagaccaagttgactatagtcattgtcggtcagggtgttgatacccatcttttccatgtaggctttgacgtttacggatggcttgatatgtttatatagattaacagcaggaatgttataggattgtgccagtgcttcagtggcagggataaagcggttttgaatctggccgccatagtcagtgacgctgtaattgttcccgagattggttttgaaatcagctaaggcagtttgcgagccgataattttttggtcaatcgcaggggcataaaccaaaagtggcttgatcgtcgaaccgggggaacggagggtataaatatggttgagttcgccggtcacgccgccaacaaagccgagaacggccccggtttgattatcaaggacaaccgatccgttttgaaccggatatttaacggtttccgtttcaccggttttcggattaatctgactactggtataagtttgaccgaacgtatcacgggttgcgcgcatgacaaattgcatgcgatcataaacatctttgtcaatcgtgctcttaatgcgatagtttttggacgcaaaaagatcgcctgcctgtcgaagataatcattgtttaaagcgctatcttttgcgagttctgctgcagaatggccatcgctttttgctaatttctcggctaacaatgatttggcttcacttagtaccatgttatagacataaccatactcatcgtcatcctggtctgctttttctggctggagaaaggcaccctttaaatcaaatgatttggcagcaacatattgacgatggctgataacgccagcccggtacatgcggaagagaacggtttgttggcgattgataccggctttgagactggttttcaatttaccatcggctgtgtaaggggtatagacaaatggactttgcggcaggccagcgatgaaagccgcttccggcaagttaacttccttagccgaaaccccaaacagtccttgagccgctgcttcaactccggcaatattttggcctttgttattacgaccaagcgtagcaacattgagataagttgccagaatggtgtttttactgaagtgattgttcaaacgccgggccagcataatttcagcagccttacgtttaaaggttgtctccgaatttaaaaacatcattttgaccacttgctgcgttaaagttgacccacctgtctgactccccataccggttaagtcggagaagaacgcacggataaccgccttaggaacgatgccgttgtggcgatagaagtcttcatcttcagtggcgataatcgccttggtgagccatggcgacatctcattgaggttgactttggttgagtacaggtcgcttttaacatcgctaagcttgacgttgtgggcaaaatacatgctggaagtgcggctggtattggacaacgttgctttcatagcagtttcagttggaattggcgttgcgtcaataatcgacacaaaatagccgccaaacaagccgaggccaaacacgacagcaatgcctaaaacgcctaataaatagtaaacagttgttttgatgctttgaagtgtcacgttgccataatagacaacggtagctttacctgttagttgttgattggtatctgctttggaatcgggatgccgggtcacgaattgcgtgaaccagcgacaaaatcgagtcccaagcgtcttgacccgattgacgaactttttcaagtgcttgtcccaccttaaattttggtctagtacgccttagtataccttaaaaacagggcggattctaatgctgtaaatggggagtgccaagtgaggtgtttggaggtttgaatgtaaggatcgttaggcttggggtggtggtttttttaggggggttacgcgtgcgcgccggtttacgttctgctctaaaacgcgttcacagtcgcagaaatctacgtgtaaggacctcagacgcaatggacaaagcccggccatcacgtctgaggccacttacactccgatttctaagcgctcctgttcacgctctggtctgaaacgcgttcaccagcccagaaacctgcacataaggaccttgagcgcaatggccaagcccgggccattgcgctcaaggccacttatgctccggtttctaagcgggttggttcacgctctggtctgaaacgcgttcaccggcgcaggagtctgcgtgtaaggacctggaacgcaatggccaaaacccggccatcacgtcccaggccgcttacactccgactcctaagcgcgccggttcacgctcttgcgacttaactttcattgtgtaagactaatagcatatgtcatgaatgagagaatggagcaggttatgtatcgaattattttgtttgatgtggatgataccttgttggattttaaggcaggggaattaaaaagcctggcaaaaatgtttgccaagctgaaattaacgtacacaccgcggattgaagcgagttatttaaagataaatgccaatttgtggcgcgattacgaagcaggtcgtatcactaggccggaactttttgaagtgcggtttgccaagttatttcggcatcatcgcattgatgctgatccgcacttggctgaacgcacttatcaccactttttggaccaagaagcgatcttattgccacatgttatggaaaccttggatgcattaaaagattatcgactcttcattgttagtaacggtattgagccggttcagcgccagcgattggccaccagtggcttgattgattactttgaggatatttttgtttctgatagtgtgggtagtcccaaaccgactgtcgcgttctttgattatgtcgctaaacgtattccgcggtttaatcgcaacgagacgttgattatgggcgactcgttaacctcggatattcaaggcgggattaacggtaagattgattcgatctggtttaacccgcattttcagccgaatcgcgatcaaattaccccgacttaccaactgaacgaatttagtgatctaactaaattgctcttggctaattaacgactgcctgaactgattagtcggctaggcgaatggtgccgctcgtaaccaccatggtaccttgggccgtttgtaacagtaaggcaccattgtcatcaaacccgctgatggttccggtcagcgggttttgtgtgccactcaccgtaattcggcggccaacccatgcagcttttgcgcgataaatcggcataatggtttccggattggcaaatagacgcatcagattggttaaaaaccgccctgccagttctggacgcggatcgctatctggttgattggaaagtaacgtggtgatcggctggtcggttggcagcactgctgattgagccggaaaaagatcaaccccgatgcctaagaccacagcgttgtgttcaatgagtgcttccgctaaaatacccgcaaccttgcgaccacctttttgcagatcattcacccatttgatcgcggttacaatgccaaactgggtttcaattgcctgctgcaacgcaacccctgcagctggtgtgatcagggactgactgatttgcggatggaatgcgtaactaagataaagccccgcatcggcaggactggcgaaatgtttgccgtgacggccgacaccggcagtttgttcaccggcaataagaatttgtgggactgtgctgttattttgaacggcgtgttttaaaacggtgttggtagaggtcactgttgcctgagtagcaacggctgcacgcaaatgaggatcgtctaaccatggatctaaagcatgaggtgtaaacatcataagcttcctttctgatttgcatcgcacaaacgccaggagtcaccgcaacattgtgagttgccgacttctggcgcttgggttgcatgattagtttaaagagcgtcaaggcgttagtgttcgcagcgcaatcaagcgggcaaagtcacttcactaaccggctaattgcatcggcatagatggcgactgctgccacaatgtctttgatcggcatatattcatttgcctgatgcatgacattttcctggcctggcatttgggcaccaaaggcaacaccgcgtttgatgatacgaccataagtgccaccgccaatgacttgttcatgaccggggatgcctgtgtgatcgctaaaagtctgaagcaatgtcttgacaagcggatcatcaccggatacatagtgtggttcctgagcgtgaccgctgactgccacattgtactgatctgctcctagcgccgtttcaatctgatcacggattttggctgcatcggttccttgcgggtagcggacattgaccagaacgctttggggaccgtcttgcgtaaaggtgaagatatccggacttgctgtcaggtcgcccattagtttatcggtataattaatccctaaattgtgaccacgtgagtctagatgaaggtggttggcaatcatggtcagataggctttcccggctggatcaaatggtaagtcggccaaaagcgttgctaaataggttgcggcgtttttgccatcttttggttcttgggcatgggcgccttttccaatcaattcaatcgttgtcgggttgcctggtgtcagagtgaaggtgacttcttgctctgttgtccacttctcggcttgcgtcacaaatgcttccggtaatggcccgctgatgacagcctttgcttcttgtggcaccatgtttggccgaataccggcggaaaaatgattcaacgttagatcagcggttgcagcggcgattggtttttgaacgatttcaaaactggcaatccctttttcgccattgatgataggaaattccgcgtctggtgaaaatccgaagtcgggagcaggttcagtttcgagatagcggtgaataccgacccagtcagactcttcatcggtaccaagaatgaagtgaatctttttattaatcggcaacttgagatcgcgaatgagctttaaggcatagtaagcagcgatacttgggcctttgtcatcgcttgttccgcgcccataaatcttgccatcgcgaataacggggtcaaatggatcggtttgccagcctggtcccgcgggcacgacatcaacatggccaaaaagcccaaagatttcgtcgccatcgcctaattcgatgcggccggcaacatggtcgacatttaatgttttgaaaccgtcccgctgtgcaatcgtcaaaaatgcttcaagcgctttggccggtcccggtccgagtggatactcatcggtttgatggtcagtatcacgttccgaattgatcttcaaaagtgtggttagatctgagagaagttggggttccaatttttcagcttcttgctgccaattaatggtcataaggttaacctactttcttactagtgttgccttaagaatagcatgtttaaggcatagaaacgaatgaatgactcgatcattgataatgcgtagtgaagacagacaccgcgcctattgatagggcaactgaagtttttaaccgatgttcaggacactggcattgagaagcggtgtatcgaaggccgtgtcgccaagtgcccagtgaaggagcggtttttggttttcggggatgctgcgatagagcgtgagccagatatgcatattctcggcggttggcagcacctgtaaatctttggcgtttaaccaaccgatttttgtttttaaatacagctggccgctttgataacgggctgctaatacccggtagcatttgtgattgccaacatggccggtaatggcttgctgatgtaagggattggcgtgcacaggtaccttaaagtgtcggctagcaatgacgatgcgctgatggagaaaaagacttgcccaaccggcttcaggggcaaggttgatggtttcggccgggacaaacgcattatcgccaatttgatagtacgtactgccagcgagtgaaaccatgctggaaatcatgatcggagtttgcggtgccagccgttcagagcgcaacaatggctgataaggattttcataaactggcagtgcagcaaggcttgagtttgccccaagatcattgatgctggtggtgacagcagctgccttaagcgtttgaaactcgtggccgaggctggtgtaattagtgacgacgccatcaatgttgagattgacgagccaagtccatttcgcccgatcctcgttcatttcatcccagacataaactttcttaccaagatcatgcagttgggtgacaagttgcggcgtcactaaatcggaacttagattaataccgtccacgtacgtcaagacgtcaaagttgatccgcttaagcgagccaacgatcaaaattcgcggaatatttggcagagctgcctgcaagcgtttgaggctagctgctgagaatgaatgaaacatcacgcgattttccatgtgatactgcttgatcagggccgcaactttgtcttctagatgcggatgcggttcaccttttacaattttagtttcaatcaggaatttatgctttgtttgttgctcatgggcgaagagttcctctaggctgtgaatcggttcgccatttttggtatgatattgctgaagttgtgcgaagtttgttttcgcgatcgccaagttggcaccagtcgttcgctgaatcgtggtgtcatgttgaatcacaatcacaccatctgcactttcatggacgtcaagctcaacgtaatcagctccgttgttaaaagcactgtcgaaactttgaaaggtctcttccggataatttaaaggatcaccacggtggccaactagcgtaaaccccgaaagcagaagaaataatggcactaaaaagactatcagtgtgagtcgtttgcccatacaggctgctcctttccagaaaaaaacatcataccacaaagatagcaccgcaacgcgactgggacaatttcccatacttcgtgaaatcaaataaggagccttaattgaaaatggcagaaaaatatcaggttttcgatttaattcaggaaataacgcgtcttgacgggagtcgttatttcgagttagggaacgtcatgatgaatggacgtgccgaaaaagccgcgatgaagggatttattaagcgggtccggatcgttcaactgaatattgcccattcgacggccgtgacgacttatgaaaaatatattaatgaacattacgagtttccaccggccgatttaacgagttgggaagaatgggacaagccggagggcccaattcgtgatgcttatcatgagattctcaagcaaaatcacgtcggttaatgggctgctgcattcacttgtctcggtgaaggtacctgtcagccgaatattttaataaaaatatcaattttaaatgaagtccagcatcattacgggtgtaggcgcgccattttagaacttccggtttaaaccggtcggggattttgcgttggattgacgccacttatataatgtaaggcatatgaaagcgaggggtccgcgtgaaatacataggtaaatggctactgccgtttatagcggcaattgcggtttttatcggcatgcagtttgatagcggcctttataccaaaccgattgggcgagtcgaagccgtgaaagtagtcaagaccgagagtcatcaggatgaagaccagaatcacgatcgtctggtgaagcaacaggtgcaggttcggctgctgaatactgctaaccgggggcggcgggtcaccatgcataatacctacttgtttagcggcggcttggataatcagctgcgggttggtgagcaggtgtttttggatgtcaataaaggcacctatacattgaacaacgtcaaacgagacgcaattctggcgggacttttggtgctaacgtttggtttgattttccttgtgatgggacggcgcgcttggttaacgagtatcagtattttgctgaatacgctgatcttctttgcggcagttgaatgggaaattggcagtaaacagtggcaagcctggtggttgtttgtcgggttagcggttgtctttactgttttaacggctgtcttcattgtcggatttaaagcgattgctgttgctatttctttgggatccttggtggcgaccggactggcagtggcgcttggttacgggattatggccatgacaaactataatggggttcattttgaagaggtcaaatatgctacccaaacgccgcaattgctgttctttgctcaagttgttatcggttctttaggagccgtgcttgatgaagcaagtgatatttcggtcgctattttccagcttcacgagacggctaaagaacgatttcgcgccggcatggccattggacggaatgtgatgggtcccttaatttccgtgcttttcatgatcttcatcgctgatacgtttatggagtcggttttgtggattcgcaataataattcgatcgcgcaaacggttatctgggtgatgggacttggttttgcccaaagtctgattagcgcattcggtattgtcctggcagtaccggtgaccagcggattagcggcgttaatggctaagattaagaaggtgacagcatgaacgcgattcttgcactagccttggtgttagtggtcatgatgtttatcgttggcggcaagcaaggcttagcgaacttctttgccttggctgccaatgccctgcttatgattttggtcgtgatattaatggccagcgggttcaatccgattattgtcgcggttatttttggcttaatcattttagcggcaacgatctttttgagcaccaatcagcttaatgttgctgggcctgcgtttgtttctgctttattgatcatgacgttgctggtcggtttgattttggtggtcatgaccttaagccagacagccggtttcgggccggaagattccgagagccttgaaggtttctcggtgtatattggggttagttttccacatattctgattgcaacaactttactgggcacgcttggcgccattgctgaagcggcgattgcggttgcagccgggatggacgaaattaaggaccaagcgagcagcgcgggcattaaacaaatgggtcatgaaatcattggaacggctttaaacacgctgttcttcggtttttttggtggtttttcttctttgtttatctggtttgcttcccttagatatcctttttcacaagtgattaataacaaaattttcgttggcgagttattgcaggtcttgatttcggttattgcggtgatcttaacggtaccgatgaccacctgggttgtggcgacaagacatgcacatcgtcggaaggagtaacatgcaatactttattgcggacacccacttttttcacgcggatcttttaggtgataatgactttgcaccgcgactttttccatctgtagaagcaatggacgatgcgatgattcaagcttggaatgcacgggttgacgatcgggatgtggtgtatcatttgggtgacattgccatgaatccggagcattttcctcagccgccggaagttttggcgatcttgttgcagcttcacggtcgcattgtttttatcaagggcaatcatgattatgaatcgttattcaaatatctgcaccggcatgacccgggcgtaaatggtttgcctaagttcacgtttcattcggttggtacgattatcaaagacgatcacacgcaatttattatgacgcactatccgctgatgatggggattgtgaagcagacgctgaatctacatggtcacattcatcacaatagtgtcaacattgcggaaaacatcaacgtcggcgtggatgcaccggagcgcgatttactggtgccgcatttgcctttcgggacgccactgacggcagctgaaatacatgagatttatcgactaaaggttgcagttttgagtaaggaacggtagcaatcagcagtggtttgaccggtcgcaatttcgggcataggatgaaattagaatggattgatagcaataccttgaaaagatgctggttgcaaggagtctaaggaggtgccttgtggagaagttggtgatcctgcacacgaatgacttgcattcccactttgaaaattggccaaaaattcggcgattcatgttaggaacacgggcggctgagcaagcgcaaggagctagtgtcttagcgtttgacgatggggatgccatggatcgatccgtgccactaaccgaggcaaccgatggccagattaacattcaattgttaaacgaaatcggttatgacgcagtaaccattggcaataatgaaggcgtcggtaatccgcatgcagtgctggaacatttatatgatcatgccaattttccggttgcacttgccaatttatttgagccggatgggaccagaccacgctgggcaaaaccggttgttatgaagcagacaccagcaggaacccgagtggcgattgtgggctttacggcaccgttttttctcacgtatgaaccgaatggctggcaggttaagacggtggcggatgttttcccggcaatacttaagcagctggagggttcgtatgacgttttggttgttttgtcgcatttaggcattgaagccgaccgacatttggcgcaacattatccgcaaatagacgtcattatcggtgggcacacgcatcacttgctccctgaaggcgaattgcatggcaccactttgttaactgccgctgaaaaatatggtcattatgttggaaaaatcaccttaaccttaaatgatgaccatcacattcaaacgcggcgagccgaaacttttcaaacggctttgttgcaaagtgccgcggcggatccacgtgaaattcaaggctatgaaagtaaaggaatcgccttattaaaacaacagcaagtcgcacgtttgcctaaacagctagccattagctacgatcggccatcgccactgcttgattttggtttagccgcggtggcagcaaccgctcagactgatgctgcaattttgaatgccggcttgtttttgacccctcttggccccggggttgtcacccaagccgatttgttagcttgcttaccgcatccgatgcatttactgaaggtgactttgagtggcaaggaactttggcggctgatcatggaaatggaaaagaatcggatgtttttacgacattttcacatgatcgggatgagttttcgcgggaaaatttttggcgatatcggctatcgcgggataacggtggatcgggagaagcggtgggttttatggcaaggtgagccgctgattccggagaagcaatatacgtttgcgaccgtcgacaactttttattcattccatttttcccaaccattgagattatgggcagtaatgaattgcttttccctaaaatcttgcggcaggttatcggtgactacatggcaaaagtttatccaagatagtttcgtgttatacttttgggaacacccacgcaaggactgctatgtacgtgcggcgatgataagccgcatgaaacgatttttagatgaaaaaggaggtcatgacttgggtgaacgatcaccattatccgaacaaatcgatgatgccttgataccggctttaaaaaaagatttacgaatcgtcaaggtcgggcacgatttgatcacgatcgatgggcgccggtatcggattgtcgagaattatcgggatgcctgcgatcttgagcgattaaatgaacgctataatgatattcttgataagtatgatttcattgtcggcgactggggatatgaccagttacggcttcggggcttttataaagacgatcgccgtggtgccagcaaagatcagcttatcagcacattagaagattacctgtatgaatactgtaattttggctgtgcttactttgtgcttgcgtgtctagacaagcccgcccctaagtcgagtccccgccggcaaggacgcgatcagcattcgcaaacgactaagaatgcgcagcgtaaacatgccaataagcacccattccatggcaaacgtaaagcaaacaaaccatacacggaaaagtcagttcgatcaccgcaatttcgcggcgaacaggctaaaaccgtacaccaaaaccaaccacgcaaatggcattttacgatccgtcaacgtgagactaacaagaagtagggacagacttgaagtataaaggttatatgattgatctggatggaacgatttatcgggggaaagaacggattccggcagcaaaggattttgtcgaacggctgcaagcagcgcggattccgtttttatttttaacgaacaatacgactaaaagccctgaagatgtcgttgataatttagccaaaaatcacgatattcatgtcacacctgatcagatttacacgccgtcattggcaacggcggcttatttgacggatcttaatcacggcgatgtttcagggaaatccgtgtatatcatcggtgagctgggcttgaagcaagctcttttggataccggattacggttaaatgaagtggatccggactatgtggtagtgggcttggattatgatgtcacctatcataagtttgaattggcgactttggccattaagcgtggcgccaagtttatcggcaccaacgcggataccaacctgcccaatgaacggggattagttccaggagctgggtcactgattgcattagtagagcgtagtacccagcagcgcgctttttacattggcaaaccggagccgacgattatggagaaagcacttaaaaaaatgggcttgcctaaagactcggttgccatggtgggtgataattacaacaccgatattaaggcgggattaaacgcgggcattgatacgatcctggtttataccggagtgtcaacgcgtgattatgtgtctaaacaagttcatcagccaacgcaccaaattgaccagttaacggactgggaggtttagatgaaacgcgctgggcagtgggtggttctttggctggcaataattagtaccgtcattttggttacgatcctgagcacgctgctgacgtttccaatttatgcacatatggatgacttaccgcaaattgccgctatgtcattaggaaggctttaccacaattacttacaattgatggcttacctgaatttcccttggattgggacacttcgaatgcaggattttccaactagtctgcatggagcggttcactttgctgacgtgcgtcgtctttttattttcgatatcctcgtggccctcgtaacgctgccttttgctattcgttggctacatcggctcaaaatcacgagtaagcgttacttgttggtgcgaccgtttatgatcggggcagtcgtgccaatcgggttaacggcactattggcaatgaactttgaccggttctttattgtttttcatgaaatgcttttccggaatcaggactggctgtttgatccggcaaccgatccgattatcaatgttttgccggaaggattcttcatgctttgtttcctattagcatttggtttgtttgaagcagtgatgatatggggcatttggcgaggacggcaagacgcacggctcgggtcaaagcaatagaaaaggcgcagtacatgttgtttataaacatgcgttgcgcctttttgttatttgatgattagcgatcagcgactttggcagtccgggttttaaccgcggcaatgaccattggtagaagtgagatcaagacgatgccaagcgcaacgagtgaaaagtgttcttttacaaaggtcacattaccgaaatagaagccgccgagcacgcataaggtgacccataaaaaaccgccaagtaaattgtagtggatgaacttaccgtagtgcatacgggaaccaccggaaacaaatggggcaaaagtacggataagcggcatgaaacgggcaattgcaattgttttaccgccatgcttatcaaagaaggcctctgcttggcgcaacttgtcacgattgatcaagcgcccgaaccagcctttaccggtagaagcagcagaaccgacacgcttaccgatttcataattaacagtatcgcctaaaaccgcagcagccaagaaaaccgcgaagagaatccagacattcaagttgtaagccgcgttggcagctaaagcacttgcggcaaacaacagtgaatctccgggtaagaacgggaagacaacgaccccggtttcgatgaagaccatcgcaaagaggatgacgtaggtccaggggccgaagctattgacgatggtgatcaaatgttcatcaatgtgtaagatgaaatcaaacaactgggtcattttgtaaactcctttaatgaattatctttcattatacgggataagatgaaagtttcatgaaacatgcgaaaattttagaaaaacatcaataaatatcgtcttcgatttccggatgggagtgggcaaggcgactggcagcagcggcagccattgccccgacgatatcatcaagaaaagtgtggatgatccccggctcgtgggcattgagcttggccagaattcctggcttaatccgatcaatatagccgtaattagtaaaaccaattgatccataaacattgacgattgaaaaggccaacacctcatcgaccccataaagtccttcatcttctgcaatgatcttctgtaaaggctcctcaagactgtttgcttcagcagccttatctaaagcgataccagtcatcacggcattttgaacctcccgtttacgcaaaacaatgcgaacgttttgggtggcttcttcgatcgtcaatttaggaatgaaccgttcctgtaagaacatgacaagttcaccaatatcactgagttgcacaccgcgctcgtgtaataactggatcgtgcgttcatacaatttctcttcatttgtcatttttcgcttctccgttcaaagtgggcgttggccagtgtgcttagcagtcggtactggcgaacacattagcggcattaggttgagttggctggttttatcgataaagttgggtactgtgcaaagcttgacggcgttccgggtaaagccgactgagcgcttcgttaatggcagtcggtgcctcaccaaagccgctggcaatcaatggcaactttccggcataactgacggcatcaccaatcgcaaaaattccgggtcggctggtttgcatctgtgaatcaaccaggatgccattacgatcggttttgaactgccatgcttgaagatgccgtttgtcagtaacaaagccataattaaccagcaatttgtcgactgttaaggtgggctggtcctcaccacgaacttcttttaagcgtacagccaggcgcttattttcgtgcgtgacggcttcgattaaatacggggtttcgatcgtcacactactcttttcaagtgcagccacactcgcctcaagtccgcgaaatttggagcggcgatgaattaaagtaacatgccgggcaatcggctctagcgccaaagcccaatcaatggcagaatcgccgccgccagcgatggcaacttcctgatcgcgaaaagtctccagatcttgaacaaaataaaaaagttgctgaccttctaaagcggggtcataatcaacggctaatttacgcggcgtgaaggcaccgccaccagtcgcaacaatgaccgttttagtgtggaaatctccttggctcgtatgcagaataaaagtgccatcatcagcctcgtcaattgtctgaacttcagtagctgttttgacgtccggtttaaaatgcatcagctgagtcttcagttgagcgaccaaatccttaccgctgacatgagggaagccgccgatatcataaagaattttggccggatataaatttccggtttgaccaccgagttcatcaagactttctaataataagacatccgcttgacgtagcccggcataaaaagcggcgaacatgccgaccgggccgccgccaatcacagtgatttcatatacatgctgcactgacatttgcaatgctccgtttctataaataatatgacgttcataccctaccatattttgctaatggttaccaaggtgacagtagtctggcaagcctgtttaaccagatatcaccattgaagggttcattgactaagggagtgcgcaaagcaaatgacatttactttgcccatattgatgatgctggtatactacgcctagtgttagaaatacgaatgagacaaatgaaggagactgattatggactatccacaactagaacttgcagaattcaagggaccaaaagcaatttttgaaaccagcgaaggacattttgagattgcactatttccaaaacaggctcctaaaaccgttgagaacttcatcggtttaactaaaaaagggtactacgatggcctgatttttcaccgcattattgccgattttatgattcaaggcggcgacccgacaggcacgggaatgggcggtgaaagcctgtggggcaaaccctttgaagatgaattttcaaatcaactatttaatctaaaaggtgctttgtcaatggccaacgcgggtcctaacaccaacggcagtcaatttttcatcgtcacgaataggcatctggatccgagcatgaaggcacaattaagcgaagccggatttcccgaaccgattatcaaagcctatgaacaaggcggcacaccgtggttagatcatcgccacaccgtttttggtcaagtgttatcaggactatcgattgtggagaaaatcggtcaagtcaaaaccggtgccaatgataagccagttgagccggtgacgatcgatcggttgacaattcaagactaatattggttgccgctgatttttagggtatactcaaagagaaatccaatgaaatgaagtgtcagaatggaatatcgcataggagatatcttgactggcaaagtgacaggggtccaaccatatggggcgtttgtcatgctggatgagcacacacaaggtttagtgcacatttcagaatgccagcacggttatgtcaaggacaccagcgatatttttaacgtcggccagcgagttgaagttgtgattttggacatcgacgaatatacccaaaaaattagtttatccttgcgtgcgttgcaagcgccgcctcggttaggtaagaagcggcgtcgcaaacattactggaccagtcgtaaatttcacaccggctttgcaccgattgccgctcatttagatgggtgggtcgctgaagcacttgaacacttagatggagaaaccactcataaatgagcggttttttctttacgcttcatcagcaatgcaggcaaatgaggcgggcatagattgttctagtttaattaaatggcattaggctgttcatgataatgaagttagggtattgcgagaatgtggtcagccagtttgcaaggttgatgcagcgaatttttagaatttgacattaacgtggcaattttgggttcacgatacgatctttagcattttgaggagatgcacgctgccttagagcttagtgtaaggagatcatggattgatgcaggacactaattgtcgttgtggcaaatggaaaacggaatgccccacagtcgttcgcaagtgtcatcaaacgttttagtgaacttttaacacgttctcccaccaattgttcgcaaaatatgcgaatttttatgcattttaattgctaacgttcgttgtttttcggaattggaatttattttgatttatgtcaattttttgttgactagttcgcgcaagtgctggtatgatacttgttgttgtcaaaacaaagacgtcgttccttgacggatgaactgatgagataaagttgatgaatcagcaagatgtgcatcattttcaataaattgaataaatattcaatttaaaaagttgttgacatgatatgctgatcatgataatctatcaaagttgtcttttgacaaagtagtcctttgaaaactgaacaaagtttcgtttaaatgtgcagggtccttgatacttcggtatcgaggcaaaaagtaacatttgcgaagtcaattcgctagaacaacaaatcgagctattcgaacagctcatatttatatgagagtttgatcctggctcaggatgaacgctggcggcgtgcctaatacatgcaagtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactggaaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcgggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggattaccctcaagcaccctagcgggtgcgactttgttctttgaaaactggatatcattgttgtaaatgttttaaattgccgagaacacagcgtatttgtatgagtttctaataatagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcctgcaagtgaatacatagcttgttggcggcagacgcggggaactgaaacatctcagtacccgcaggaagagaaagaaaactcgattcccatagtagcggcgagcgaagtgggaagagcccaaaccgagaagcttgcttctcggggttgtaggactggacattggagttaccaaagttcgacgtagtcgaagtcagctggaaagctgcgccatagaaggtgaaagccctgtaaacgaaacggcggactctccgtccaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaacagttcctgaaaccgtgtgcctacaattagtcaaagcccgttaacgggtaatggcgtgccttttgtagaatgaaccggcgagttacgtttgcctgcgaggttaagatgaaaagtcggagccggagcgaaagcgagtctgaacagggtgcttcagtaggtagatgtagacccgaaaccaagtgacctacccatgaccaggttgaaggtgtggtgaaacacactggaggaccgaacccatgtatgttgaaaaatgctgggatgagttgtgggtagcggtgaaattccaaacgaacttggagatagctggttctctccgaaatagctttagggttagcctcggaggatggatcatggaggtagagcactgtttgaactaggggcccgtcaagggttactgaattcagataaactccgaataccattgatcttactccgggagtcagacagtgagcgataaggtccattgtcgaaaggggaacagcccagatcaccagttaaggtccctaaatttatgctaagtggaaaaggatgtggcgttgcacagacaactaggatgttggctcagaagcagccaccatttaaagagtgcgtaatagctcactagtcgagtggcactgcgccgaaaatataccggggctaagcataataccgaaactgtgggtgcacccgtcagggtgcgcggtaggagagcgttctaagggcgttgaaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgcaaggcgtagtcgatgacaagcaggttgagattcctgcactagtttattttgtttaagcgatggagggacgcaggaggctaaggaaagcgcacggctggaaaagtgcgtccaagcagtaagtccggtggcgagtgaaatgcttgccgccttaaggacaagctgtgatggggagcgaaattaaagtagcgaagttcctgatgtcacactgccaagaaaagcttctagtgagaaataaactacccgtaccgcaaaccgacacaggtagtcgaggagagtatcctcaggtgagcgagcgaactctcgttaaggaactcggcaaaatgaccccgtaacttcggaagaaggggtgctgaccgcaaggtcagccgcagtgaataggcccaaacaactgtttatcaaaaacacaggtctctgctaaatcgtaagatgatgtataggggctgacgcctgcccggtgctggaaggttaagaggatgagttagcgcaagcgaagcccagaattgaagccccagtaaacggcggccgtaactataacggtcctaaggtagcgaaattccttgtcgggtaagttccgacccgcacgaaaggcgtaatgatttgggcactgtctcaacgagagactcggtgaaattatagtacccgtgaagatgcgggttacccgcgacaggacggaaagaccccatggagctttactgtagcttgatattgagtgttggtaccgcttgtacaggataggtaggagccgtagagatcggaacgctagtttcgatggaggcattggtgggatactaccctagctgtatgaacactctaacccgcgccactaatcgtggcgggagacagtgtcaggtaggcagtttgactggggcggtcgcctcctaaaatgtaacggaggcgcccaaaggttccctcagaatggttggaaatcattcgcagagtgtaaaggtagaagggagcttgactgcgagactgacaagtcgagcaaggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgttccgctggtgtaccagttgtgccgccaggcgcatcgctgggtagctatgaacggaagggataaacgctgaaagcatctaagtgtgaagcccccctcgagatgagatttcccattcctatatggaagtaagacccctgaaagatgatcaggtagataggctggaagtggaagtgcagcgatgcatggagcggaccagtactaatcggtcgaggacttaaccaagtaaagcgcaaactggcgctaagccagcgcgcgcgtttcgatgaaatacgttaagttccggcaatgtaaaccaacaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgcttacatatggaggattagctcagttgggagagcgtctgccttacaagcagagggtcacaggttcgagccctgtatcctccattgagccgttagctcagttggtagagcaactgacttttaatcagtgggtcgacagttcgagcctgtcacggctcagagaattattggttttaattggcggctcaagtcgatatttttgccgacttagctcagttggtagagcatctgtcttgtaaacagggggtcgaaggttcgaatcctttagtcggcatggcaccaataatttgataagcattttgtttcatgcggaagtagttcagtggtagaacatcaccttgccatggtgggggtcgcgggttcgaatcccgtcttccgctttccgagcacagtgccgagggtgtgcttggtcgaaaagttcctcggcattatcatgatttgcacccatagcgcaactggatagagtgtctgactacgaatcagaaggttgtaggttcgactcctactgggtgcatttaacgggaaatagctcagcttggtagagcacctggtttgggaccagggggtcgcaggttcgaatcctgttttcccgattggacgcttagtccatatgtttttctcgcggtgtagctcagctggctagagcgtccggttcatacccgggaggtcgagggttcgatcccccccgccgcgattgagcttggacctttagctcagttggttagagcaggcggctcataaccgcccggtcgtaggttcgagccctacaaggtccatctttacaggcgggccactgttcggtataatcagtttgttactgttatcgcgggatggagcagttcggtagctcgtcgggctcataacccgaaggtcgcaggttcaaatcctgctcccgcaattaatatggttccatggtctagttggttaggacgcctgcctgtcacgcaggagatcacgggttcgagtcccgttgggaccgtttgcggctcggtagctcagtcggtagagcaatgcattgaagctgcatgtgtcggcagttcgattctgtcccgcgccatattcataatcatccttatgcgggtgtagtttagtggtaaaaccacagccttccaagctgttgtcgcgagttcgattctcgtcacccgctgcggttatgatattgggcctatagctcagttggttagagcgcacgcttgataagcgtgaggtcggtggttcaagtccacctaggcccattgcaccacttaattttatatacacatggagaagtactcaagtggctgaagaggcgcccctgctaagggtgtagaccgggaaactggtgcgagggttcaaatccctccttctccgttgtggcccgttggtcaagtggttaagacaccgccctttcacggcggtaacatgggttcaaatcccgtacgggtcatggttaaatggagaattacccaagtctggctgaagggaacggtcttgaaaaccgtcaggtggatgtcaatccacgcgagggttcgaatccctcattctcctttataattatcgcgggatggagcagttcggtagctcgtcgggctcataacccgaaggtcgcaggttcaaatcctgctcccgcaattaatatggttccatggtctagttggttaggacgcctgcctgtcacgcaggagatcacgggttcgagtcccgttgggaccgtccctctcgatttgagaggaacaaattctataaaaagattcaaatggctcggtagctcagtcggtagagcaatgcattgaagctgcatgtgtcggcggttcgattccgtcccgcgccattatggaggagtagcgaagaggctaaacgcggcggactgtaaatccgctccttcgggttcataggttcgaatcctatctcctccattcatagggatatagtttaatggtagaactacggtctccaaaaccgtcagtgtgggttcaactcctactatccctgctttataatggcggtattggtgaagcggttaacacaccggtttgtggcaccggcatacgtgggttcgatccccacataccgcccttttattggggtatagccaagcggtaaggcaacggactttgactccgtcatgcgctggttcgaatccagctaccccaatttctccaactgccataggagaaatgcactcaacttgatgaatatggcggtgtagccaagcggtaaggcatgggtctgcaaaaccttgatcgtcggttcgattccgatcaccgccttatcttgcggctaaaccccagcaagacagagtgttagctatcattattatgccggtgtggcggaattggcagacgcgcgggattcaaaatcccgttccagcgatggagtatcggttcgaccccgatcaccggtatcacaggccccccctagaggggcttttttagtgctcagaaatggctttaaattgggattcttgttttttctgggcgcttaaaaatccctaaaaaaagatgcttttaccgactacttttgctttttggggggtattttgctaaaagtggtcggttagctcgtaattccaaatgacgctactccttgtgtgtcaaggtattgagagccttttgttggtcggcaaagtggtcgctggctatcataaaactttaacgttgttcgccgcttgtcttggagccaacttgtctatcagaggtttgtggatttttaaaatgatttcgatgttctcatgtctagagcgccgaaagacgaattaaacagccatacccttaacaggcaaatactactgtgagtgtggcgaagggtatggaagttcaaacttaggccaagcatgtctaaacgcatacttgcacgacggatttcgcagttacggcatcaccgttaactgcttcctcgtataaacagctggcgagtcacccaagaaagatagatgggagtcgctttcgcttaatttgtcagacgagatagattgggagcctttgtaatcaaggacgaatcttccttaattgtatgcggtgataccaacagatggcgttgagagagaactaaatctggcttgcgtttccttagcactcaagtacaacagatcgattgcaatgcttacagcgaaaattcaagcaaaaaattgtcccatgattgccttggacacggcaatcatgggacaatcttgaactggcctaagagctcacagcttgggattaatcttcccgtgtaaacttaataatctttgctcgtgagcgttctaaagcacgacggaaacgattgcttgtgggcgtatcaaacggatgcaagactgccgtctcaaacgcctcatattccaggggtgacaggttttctagaagctgaaaaaattcaacacgcatgagcaatccgtcttcgactgaacgtattgctagccgttcctgcaaagattcgagcgcactcgctttgaatggaatagcggtagcatcaatccgacgcttatgggcaaagtgtctgcgcaagattgaacgtaagtgggactgtaacaccattcgataatacggcccaaattgcgagccgctgctgccatcataacgcgcaacagcttttatcatggcaattctggcctcttgcaaccaatcctcataggaaaattctctgaggttgtagggttttaaaacctttaaaaccagagggcggtattgttcgaatagtttacggaaagcttctgaatcgttcacagcttctcttatcaagctcagttcttcttttttcatatatcctcctcccctgatctactagcaagatcattctacaataaaacgtttacaattgaatagggaacaattgttcaggtataactttttatacaaggacatgtataagaaatcgcaaagaatcagcttttctagggcacaaaattattaacattattttcttattttttcaattagaatcaaagaatgcgtcccgatcaagttgaatgactgattagcgcgtggacatcgtgatccggtttgattggcacgtttggctaaaattggtatggtaaatagcctttatatgaggagactgtctgtactttaatagtgggctgaatggtacctgtagaaataaagtttaaaaagctgcccgatgcgtaaggaagagcttttgcgcttgatttaacgaggtgagttattttacatactccgtaatctgcggtaacctaattaggtcattttataaggaggtttccaactatttcttcaaaaacaaaagacaacaaaattggtctatttcagttagtcatgttggcacttggttcgttaatcggatcgggctggttgtttggatcgtgggaagcggcagaagtcgccggaccagcggcaattttttcttgggtcattggcggcgtcattatcggtgtcattgcctataattacgtggagttaggtacgatgtttccggagtcaggcggaatgagtaaatttgcgcagtattcgcatggctcattggttggcttcatagcatcatgggctaactggatttctttggtgacattattgccaattgaagcagttgccgcagttcagtatatggcatcgtggccatggaagtgggctgtttttacccacggctttttacatgcagggcggattaccccacaaggactgttagtggtctttgcgtttatcatcatttttacgttgcttaattactggtcagtgacgttgctgacgcgttttaccagttttatttccatttttaaaattggggtaccgttgttgacgatcgttttgctggccttgtcgagttttcaccccgaaaattatgggcattcgttggcaaccttgatgccttatggtagtgcaccgatttttgcggcgacttcggtttcagggattatcttttcttttaacgctttccagactgttattaatatgggaagcgatgtgaaacgcccgcaaaagaatattggtcgcggcatcgggatttctttgctcattagcggaattatttatattctgctgcaaagtgtctttatcacgaccatttctcccgatatgcttgctgctcatggttggaaaggcctgaaccttaactcgccgtttgcggatttggcaattttgcttggtattcactggctgtcggttttgctatatatggatgcgtttgtttcgccatttgggactggcgtttcgtttgtcgcctcgtccggtcgtgcgcttcaggcgatggtgggcaacaatcacattcctaagtttatcggtaaaattgacgaaaagtacggaactccgcgtgtcgcgatggtggtcaatgctgtcttaagtatgattatggtctctattttcccatcgtgggggacgcttgccagtgttatttcaacggctacgttaattgcttatctgacaggaccggtcacggtgatctctttgcgtgaaatggcgcctaatttcaagcgtccggtcaaatcagcgatgttgcgagtaatggcaccgttggcatttgtgttgacatcattagcggcttactgggcaaaatggccaaccaccgttgaagtcattggggttatcttcttagggattccgttgtatctgttttatgaatggcgatcaggttggcgcagtacctggcagcagttaaaagcctcggcgtggatgcttggttacctggtttttctctcggtaatttcgctgattggcagtgctgagtttaatgggttgaactggatccattatccaatggactttgtcgtcattatacttggcgcggtggtcttctatttctgggggatcaacagtcatatcatatcgaagtacttccgtaaggccgcgcgtgttaacgataaagttaaaatgcctgcagcggaagacatcgagcgtgacaagtaaccccaaaagtgaagatgttaatatgtattcataaatgaattaatagatatttcttcaaaaaagataggttgtaaatgactgattgtcgggatgtttcgcaagcggctgcttaaaaatttacgacttttgccggatgatgttcatctgatggcaaggtaagataattttaaaggtttgtgagaaaattgcatttagccatgcctatctttatacttatactaaacaaatgacgtctggaggggatcaggtgaatatcgggatttttacagacagctattttccgcaagtcagtggtgtcgcgacgtccatcaagaccttgaaggacgatctagaacgtaagggtcatcaggtttatattttcacgacaaccgacccacatgtgccagatgatgcggtcgaaccgaacttgttccgatttacaagtgtgccgtttgtttcttttactgatcggcgtattgcggttcgggggctgtttcacgcttatgcagtggctaaggaattaaatctggatattgtgcatacacaaactgagttctcaatgggttacattggtaagtttgtggccaaacaactgaaaattccaacgatccatacttatcacaccatgtatgaggattatctgcattatgtcttaaacggtcatctgctaaagccgtaccatgtcaaacaatttacccgcgcttttctgtatcacgtaagcggtgtgattgcgccgtctgagcgggtgtatgatacgttgcggcgttatggcgttaagaccgacattaagattattccaaccggagtcgatttaacgcaattcgcagagcaaaaggacccgcacttacgggaaaagctgggactggcagatgtgccggtattggtttcgcttagtcgcgttgcttatgaaaagcgaattgataaattaatcagcgccatgcccgcaattttggcgcaaattcctaaagcagttctcctaattgtcggtgatggccctgcacgtgaagatctagaggcacaggctgctgaattagggattgccgatcatgtccggtttaccggtgaaattgaccatgatgatgtaggcgactattatcgtgtcggcgatgtttttgtgtcggctagtgattcagagtcacagggactgacttatattgaggcaatggccgctgatcggaaagttgttgcccttgctggtgattatactgatcaactgttggatgatccggcgttgggaacaacttttacgactgaagcagaaatggttcatcaagttgtgaattatctgaagcatcctaatgcctatgatgatcccaaaccgcgaactgaaaagctggcggcaatttctgctgatcggtttggcgatcgggtacttgatttctatcgcgatgttatcagtcactattccccgaatgaagctgatgaaactgtgccatggaccgatgaaagtagtagcaaacggaccatgaaaggttaactatgatcgttattaacatgttttcttcagccaataaggttgctgggcaaggcgtgggtgcagtttacacagaactgatgggactgttgaaacacgattttgccaatgaatttcaaattaatgtcaatcgttatacgcgcagtgatattagtcattatcatacaatcgatcctaagttttatttatcgacgttctccaaaaaaagaggccgcaaaatcggcttcgttcattttgtgcctagtactttagatgcgagtttaaagttgccgcgagtggcgcggtggacactagaccgctatacgttagctttttacaaacgtatggatgaacttgttgtcgtgaatccaaacttcattcctaagcttgaggcctatgggattaatccggacaaggtaacgtacattccaaatttcgtttctcaacgtacgtttcatccggtttcccgggaaaaaaggcaggcgttacgacatgcgaatggttttaagccggatgattttgtcgtttttggcgccgggcaagtgcaagatcgcaaaggcgtcggtgatttcatcaaactcgcgcaacaaaaccctgattaccgctttgtctgggcggggggcttttcttttggccgcattacagaaggttatgagcggctcaaaaaggcagttgcaaatgcgcctgccaacctgaactttaccggtattatgccgcgagaaacgatgatcgattactataacatggcagacttgttccttctgccatcttttgaagagttgttcccaatgtcggttttagaagcatttgcaacggatacgccggtaatggtgcgtgatcttgaattgtatcagcaaatcatcacgccttatacaattacggcggtggatgtggcagacatgcaggcacgaattcgggcattagccgatgatcgcgagcttttggcaacatatgcggccaagagccatgaagcggcgcaggtgtacgatgaagctcggcttgaaaaagtctggcatgatttttacgtgcaacaagcagcgttgggtaaacactagccgaggagttatatgacacggaagaacaaactggccgtcttcatcatggttctgattggcgccggcatttttatttatgaagcacgtgatcttaatggtgcaaaactgatccatgaacttttatcgcttgatcttaagtggctgttagtggcttttttactgatgtttggttcatggatcgttgaaaccttcgttgtgcagatttttattaaaaacggatcggacgaattagactttaagacagcgtttcgggttccgcttgtcgagcaactattcaacgcaattacgcccatggcatctggcggtcaaccggctcagctgtttgcactcatgcaaagtggggtggaggctggtcgcgcgagttcggtactgttgatgaagtttgttgtgtatcagtttatggtcctgattaactttgtactcactttacttatcggctttgatcaagtgtctcggcattttggggcccttgcgatcttcatcgtctttggctttgttatccacgtgatcgtgattgtcggcttgctcatggtgatgtactactacaaattcaccaagaagctcgtcagaatcatcatgataccagtcggctggttcgtgaagccagaaaagaagatggcgatgcagcttgatctggatcacaaaatcgatactttttacgccgagagcctgcacttaaagcgcgaaaaagtccgtgtaattaaggcgtgctttttgacgttaattcagttgctgctttactacgcggttccgtattttgtgctattggcactgggtgtgaatcacgttagcattgttgaagtgattgtgttacacgtgatgattgtgatgattgtcagtctgtttccaattccgggtggagctggcggtgcagagtatagttttaaaaccctgtttgcgacgtatgtggcctcaccatctaagttagtgcttggcatgttgttatggcgctttttaacttattatctaggaatgatctgcggcattgttgcaatggcattacctccaaaaaaagacgcgtaaacacccttcagccagtcagcttggttcaaggttttctggcggatggatggcaagctgaaattaaattaaatgggatcccggagacagttacttatgtcttcaggatcccatttttaattgatgatgattcaaaacgcgtgcggattctttccgtttacgcttgattagccgatgtggctggccatgaacgcgcgcaatcgcttaacggcttcttgaagatcggtcattgatgccgcgtaactgattcggatataaccttcgccgccggggccaaaagcggtacctgaaatcagagctaacttctgttcatgtgccaaggcgtgcgtaaattcgcgtgagcttagatgcagttgggtcggaatttttgcaaaaagataaaaggcaccatcaggacgagccacgctaaagcccatgtcgatgagggcggcataaacaaaatcacggcgtttaacgtaagctgctttcatcacctgagcatcgtctgcaccgttcgtcagagcttcaataccagcgcgctgggcaatggtcgttgcggcagtcacaagatattggtgcacctttttggcttgcgcgattaactgctggggacccatcaaaaagccgattcgccagccggtcattgcatgtgatttagacagaccgttgacaataaatgtacgatcgtaggcaaattgtcccatggaaacatgcggctcaccataagtcagttcagaataaatttcgtcacagataatgtagaggttatgtttagcggcgatgtccgcaatggctttaacttctgccgcccgatacgtgacaccggtgggattacttggatagttaaggataatgcctttgattttagcgtcaggatttgcagtgatggtggcctcaatgagttcgggggtcaagacaaagtcggttttactcgtatccatataaagcggcgtaacgtgattcagcgtcagaagcggaatgtagcccggataaattggtgacggaaccagcatggcatcacccggatcactgatcgtcgtaatggcggttgccagtgcttcagtggccccgactgtcaccagaatttcatctgtagcccgatagtcagtggcatatttcgttttaaaaaaatgttgtgcggcttcgcgtaactccggatcaccaaccatcccggtataatgcgagtaattttcctgaatggctttgatcccggcttgcttaacatgttccggggtgttgaaatcaggttcgcctagcgtcagtttcaaaataccgggaatatcactgacactttcgtcaaattgtcgaatctcactaacctcgatggcaggtagttgttcgtttaaaggttgcaatgtcatacaaatctccttaataaagtaagcgcgagccaaacccgatttctgggcaggagagcgcattatgatgtaaacgcgaaccgatgcagttagaagtcggagttagacggctacaactaaaagattgcctaactgacttttacgctggcaaacgcgttataatagcatgcaaatagcatagtccatttgcctatcgacacgcaacgtcataaaagtagaattcaaagtgatatttctcccacagaggcgacggtttatgctaagctatttcttgaaataggaaaaattaggaggccattttatgaaacaatcacagctcgtggccatcatcaagcgccttgaagccatgcaggcaggcgatggcgaggcacagtcacgccgcttcgaaaaaaatggtgatgaaaagggcctcgtgacgtacgatcccaagaccgaaacttacgaacttgaagaattaggcactcaccagacgttccagtttgataatatcgatcttgcggccatggaaatctatgatctaatggattttgatgaagacgagggcactaacggtactgatagtagcgatcaggctcaagcttgagttctgagtaaagcggacttgcgaaggttcgctttttctgtgtgaatcttttctgatttgaaggatcagtagtatgaaatttgactgatgttgagttaaatggcggttgacgcgcaccgccttgctcaaacgcattcaaatgtaggctattgataggctgttgagtagatacctgtatcagtttcaacaagctcgagagaaagactgccacattgcgaatggccgaattgaactgaaaagcgttaggccgtgtttgtcactaaaatgacatcgcggctttttagtaagcgcgagccggcgcggttagagaccggagtgtaagcggcctcgagcgtgatggccggtctttggccattgcgcttgaggtccttacatgcaggtctctgcgccggggagcgcgttaggagataggcggtttacaaaggatcaattttaaaccgttgaaaagatttaaacacttggcaacgagccactaacttgaatgacgtggttttaaggcttctttaagattgcgcttgatccgactgtaatcggcattgaaagtttgtcttttaaggaatgagcggttatcctagcgaatgtgctatacttttgacattaaacaatgacttggaggctccacatgaaccagatcggcgctaaaattcgaggatttttcaataccagactcggttttctggtacttgccattgtcttattctgggcaaaaacttattgggcatatcaagctaaattcaacttaggggtcactggtagctttcagcatttaattctggcagttaatccgattccgacaacgctttttctttttggaattgctttatatatgtcgggacgtaaatcgtatgtcacgatgctgattatcgatgccctgacgtcggtttggctttttgctaatgtactttattatcgggaattttccgactttctgacttttgctttaatcaaaggatcaggtgcggtttccaataacttgaacaagggaattatggggatcgttcagccgacagactttcttgtgtttgtcgatgttctatttttgattttactgttagctttcaaggttattcggatggatatccgcccgatcaaaaagcggtttgcactgggagtttcgttgctggccgtgttaatgtttggggcgaatctggctatggcttatagcgatcgttccggactgttgacgcgcacgtttgacaataactacattgtgaaatatctgggtctcaatgcctatactgttgttgacggggtcaaaactgccagcaatagtgcaacgaaggcaaacgctgattcaagtgatgtcaaatccgtactgaattatctcaataagaatcgcgttaccccgaacgcagaatataccggtgtggcaaagggtaagaatgtttttgtcatccacttggaaagcctgcagcaatttatgattgacttcaaatgggatgggcaggaagtcactccgaatctcaataagctttatcatgaatcagacacactatcttttgacaacttctttaaccaagttggtcaagggaaaacggctgatgcggaaatgatgatggaaaattcattgtttgggttgcctgaaggggcggccatggtaactgacgggacgacgaacactttccaggcggcaccagcaatcttagatcaacagggttacacaaccgcttcgttccacggggatgtaccaagtttctggaaccgtgataatacctataagtcttggggatacgactatttcttttctaagagttacttctcaagtgggaaaaattatgatgtcggctatgggttgaaggacaagattttcctgaaagattcagcgcagtacattgaacaactgccgcagccgttttatgccaaaatgattacggtcacgaatcactatccttacacactggacaaggaaaatcagaccatcagtaagaccgacactggcgatgataccgttgatggttatgtccagacagcccgttatctcgatgaagcaattggtgaattctttgactggctgaaggaaaccggactgtacgataagtcaatgattgttctctacggtgatcattatgggatttcaaacaaccataaaaaagccatggccaagttaaccaacattaccggttttaatgactatgacaatgccatgtatcaacgcgtaccatttatgattcacatgccaggactaaaaggcggcattaatcacacatatggcggtgaaattgatgccttgccgacaatattgaacctgttaggtattaaggacaatgatacggttcagtttggttcagatttgctctccgctaatcatccgcaaacagttgcgttcagaaatggtgatttcgtcacacctgatttcactaaggtaggcagtcaatactttaataccagcacagggaagaaaattaccaagctatccccaagccaaaagaaaacggttgacgctgctactaaccgtgtgacaacggaactgtccttatctgatcgcgttatcaatggtgatctgcttaggttctacacgccaagcggatttaagaaggtcgatcgtagcgacttttcgtataagctaacggatacgaaaaagaagctcaaagccgcacagaagaaaggtacaagcttgaaagcagaaaataagggtaaatcggtggcaaatgaatataagaccgatgcgccagagcttaaaagcgatgatgacgaaagtagtagcgaatccaaataagcgactaaagcttttcgacagtgtctttttaggcactgtttttttggactgatatgaagctaaatttaagcgataattggtaacacatgcatttagtgtacttttgaattttgaaattttctaaacatttgtaagtgaaaaggttgtgctaaattagaaaaaagcgtacaattttactagatgataatagttacaaattaggaggctgacgatgaatcaggcagtttataacaaaacaattaacttgctcaaagcaaagcagattcgggtcaccccgcagcgcgaggcgatcatttcctatatgatcgacagtacggcacacccgacagctgaaatgatttatgcaaaactatcgccacagtttccacatatgagtgtcgcaaccgtatacaacaatttacgtctactggtggatcttaatttagttgaggaaatgtcgtctaatgatgcggcgactcattttgatttcccgattgagccacactaccatgcgatttgtaccaactgcggtaagatttttgacttcacttacccaggggtcacggatgtggaggcagtggcagctaaaaaaaccggtttcaaagtcagtgggcatcatctcgaggtttacggtatttgtcccgagtgtcagattaaactgggtatgaaataagcctacgttactgttcggatggccacgctttaaaatgagattttatttggatgcagctatcaagcataattgatggctgtttttatttggcgatagacgctgcaaaggataagtcaccgcaatatctaacgtgcaatgatcctgtgctttgagcaacgtcaatcaagcaagacttttttgaaaaaatgcttgcgcctcaaccggcttgctggtattatattattgctgtcaaaaagcagatccctttttggggtaaagataaaaatagtcatgaataaaacatatgaagcgtttttaacaaaaaatgttgacatgatatgctgatcatgataatctatcaaagttgtcttttgacaaagtagtcctttgaaaactgaacaaagtttcgtttaaatgtgcagggtccttgatacttcggtatcgaggcaaaaagtaacatttgcgaagtcaattcgctagaacaacaaatcgagctattcaaacagctcatatttatatgagagtttgatcctggctcaggatgaacgctggcggcgtgcctaatacatgcaagtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactggaaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcgggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggattaccctcaagcaccctagcgggtgcgactttgttctttgaaaactggatatcattgttgtaaatgttttaaattgccgagaacacagcgtatttgtatgagtttctaataatagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcctgcaagtgaatacatagcttgttggcggcagacgcggggaactgaaacatctcagtacccgcaggaagagaaagaaaactcgattcccatagtagcggcgagcgaagtgggaagagcccaaaccgagaagcttgcttctcggggttgtaggactggacattggagttaccaaagttcgacgtagtcgaagtcagctggaaagctgcgccatagaaggtgaaagccctgtaaacgaaacggcggactctccgtccaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaacagttcctgaaaccgtgtgcctacaattagtcaaagcccgttaacgggtaatggcgtgccttttgtagaatgaaccggcgagttacgtttgcctgcgaggttaagatgaaaagtcggagccggagcgaaagcgagtctgaacagggcgcttcagtaggtagatgtagacccgaaaccaagtgacctacccatgaccaggttgaaggtgtggtgaaacacactggaggaccgaacccatgtatgttgaaaaatgctgggatgagttgtgggtagcggtgaaattccaaacgaacttggagatagctggttctctccgaaatagctttagggttagcctcggaggatggatcatggaggtagagcactgtttgaactaggggcccgtcaagggttactgaattcagataaactccgaataccattgatcttactccgggagtcagacagtgagcgataaggtccattgtcgaaaggggaacagcccagatcaccagttaaggtccctaaatttatgctaagtggaaaaggatgtggcgttgcacagacaactaggatgttggctcagaagcagccaccatttaaagagtgcgtaatagctcactagtcgagtggcactgcgccgaaaatataccggggctaagcataataccgaaactgtgggtgcacccgtcagggtgcgcggtaggagagcgttctaagggcgttgaaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgcaaggcgtagtcgatgacaagcaggttgagattcctgcactagtttattttgtttaagcgatggagggacgcaggaggctaaggaaagcgcacggctggaaaagtgcgtccaagcagtaagtccggtggcgagtgaaatgcttgccgccttaaggacaagctgtgatggggagcgaaattaaagtagcgaagttcctgatgtcacactgccaagaaaagcttctagtgagaaataaactacccgtaccgcaaaccgacacaggtagtcgaggagagtatcctcaggtgagcgagcgaactctcgttaaggaactcggcaaaatgaccccgtaacttcggaagaaggggtgctgaccgcaaggtcagccgcagtgaataggcccaaacaactgtttatcaaaaacacaggtctctgctaaatcgtaagatgatgtataggggctgacgcctgcccggtgctggaaggttaagaggatgagttagcgcaagcgaagcccagaattgaagccccagtaaacggcggccgtaactataacggtcctaaggtagcgaaattccttgtcgggtaagttccgacccgcacgaaaggcgtaatgatttgggcactgtctcaacgagagactcggtgaaattatagtacccgtgaagatgcgggttacccgcgacaggacggaaagaccccatggagctttactgtagcttgatattgagtgttggtaccgcttgtacaggataggtaggagccgtagagatcggaacgctagtttcgatggaggcattggtgggatactaccctagctgtatgaacactctaacccgcgccactaatcgtggcgggagacagtgtcaggtaggcagtttgactggggcggtcgcctcctaaaatgtaacggaggcgcccaaaggttccctcagaatggttggaaatcattcgcagagtgtaaaggtagaagggagcttgactgcgagactgacaagtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgttccgctggtgtaccagttgtgccgccaggcgcatcgctgggtagctatgaacggaagggataaacgctgaaagcatctaagtgtgaagcccccctcgagatgagatttcccattcctatatggaagtaagacccctgaaagatgatcaggtagataggctggaagtggaagtgcagcgatgcatggagcggaccagtactaatcggtcgaggacttaaccaagtaaagcgcaaactggcgctaagccagcgcgcgcgtttcgatgaaatacgttaagttccggcaatgtaaaccaacaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgctgtttattccggtttagctcagttggtagagcacctgactgttaatcaggttgtcgtcagttcgagcctgacaaccggagttttttatggagagttgtccgagaggctgaaggagcatggttggaaaccatgtatacgggttttgcctgtatcaagggttcgaatcccttactctccgttttattgtctctagttgctttccatagcttcccaaaacgctgatatgatagtgttttgggatttttattttcttttgtttttggatgttttaaaaattttgagaccaaaagcctatgctacaaaagtaaaattgacgctaatttttatttgtaataaatgtttaaagtacttgccattcttggctgtctccggtagtcttgtacaagtagtaatcgtcatggaggattagctcagttgggagagcgtctgccttacaagcagagggtcacaggttcgagccctgtatcctccatcagtttacgtccgctgtcattgcgggcgtttttttgaattgttaagctaattcaacgtctaaactttgattgtgatatcgtgaaagttaaaaaaatcctccctaaactgttgaattaagggaggagatttagtgttgacggtgatgtttatgctaaccatgcatgcgtgctaagtagagtagaagggtcatgattaatgggctgaattgataaatgtaacgaggcaatttaaagggacgtcgactgttaatgacggtgacaatgatgaacatgccgccaatggcaatgaagtttattcgttgctgtacatagccaaggatggcaacaaccagtaggagaatcagatcggtccacttaggaaaacggttggcccaaagcccgatcagcgcaggtaaatagagaagcgctaggtctagcagcatggtgcgattgaagaaatgcaggctggcatagattagcgtaatttgaagtagcagggcctgaccaaaaacgacagtgtcaacccagagcgcaggcattttttgcgtctgtaaaagaaacgcaatgacgatttgaacaataatgagtggcagtagcagccattgattgattgtgccgatgataccgctaacgcctgctatgagcagtaggagcataagcttgtttgaactgacgagtgttgttccagcaagacatgttgtcataaacagtaatgcgacaagttgaaaagtccagttgacttgcagcgccatagcaattaaaaatgggtaagcaagtgcctggcctaagaatgcgattgcgtaggcgctttgatcgatttttttcaagatggatgtcctttctatatagcctcattttacaaaaccacgttgccagagacaaagattttcggaatttttatattttttatgttatgctactagagttgcaatacattcccgatggggttcgttagcgattaacgaacatgccttgtaaccgaaaatcatgagggggaaacaaacgatgcaagaacgccatttatttacttctgagtctgtatcagaaggacatccggataaaattgctgatcaaatcagtgatgccattctggatgcaatgctcgaaaaagatccgaattctcgagttgcgtgtgaaacaactgtgacgacgggattggtgttggtggtcggcgagatttcgaccaatgcttatgttgacattcagtccgttgttcgtggcacgattaagaaaattggttatacaaaagagtctgggtttgatccggatagtgtcggtgttttggttgcacttgatgaacagagcccggatatcgctcaaggtgtggatgaaagtcttgaggcccgcgattccgataccgatccgttagataaaatcggtgccggtgatcaagggatgatgtttgggtttgccattgacgaaaccgacacctatatgccattaccgatttcgttggctcatgccttaatgcgtcaaacggataaattgcggcacgctggcgaaatcagttatctgcgcccagacgcaaaggcccaggtaacagtagagtatgatgataacgagcagcctgttcgggttgatacagtagttctttctgttcagcatgatcctgacgtcacactggaagaaattcggcgtgacgtagaggctaaaatcattcggaagatcattccagctgacatgatggatgatgacacgaagatttatgttaacccgaccggtcgctttgtcttaggtggtccgcaagccgattccggattgactggtcgtaagattattgttgatacttacggtgggtttgcccggcatggcggtggggccttttccggtaaggatgcgacgaaggttgaccgctctgctagttatgcagcgcgttatattgctaaaaatattgttgcagccggcttggccaaacgcgtggaagtgcaactggcttatgcgattggcgttgctaaaccggtgtcggtatctgtcaacacatttggcaccaacgttatttctgaacaagtaattgaacaggctattcgcgagaactttgatttgcgcccagctggtattattaaaatgttagatcttaagcggccgatttatgaacaaacagcggcttatggtcattttggacgtacagatgttgatcttccttgggagcacttagataaggtgcaagcacttctcaagtatcgagattagcgagaaaagaggcggccttggacgggcgtattcccatccgggtcgtttttttatgctttggtggtgtgagattagcactggcatcgcgctggctcgcgctcacattttttaaggagtaatttatgaagcagagaaaaacaaatgttgctgttgtgacggcggcaatttttatgggtacttttatgaccgccatcgaggggacgattgtctcaactgcgatgccgacgattattggtagtttacatggcgtgcatcttatgaattgggttttttcaatttttcttttgactaatgcgatggcaacgccgatttatgggaaattaagtgacaaaattggccgtaaaccggttttcttgattgggctgactgtttttgtcatcggttctttgttatcgggtttgtcgcagtcgatggtgatgctgatcgtctttcgcgcgattcaaggggtcggtgctggtgccattatgccggtgacgtttaccatcgttgccgatatttatccgtttgaaaagcgggctaaaatgctggggtttaatggttcgatgtgggggattgcatctgtcattgctccgttactgggtggcttcatcgtggatcaattgagctggcattggatcttctttattaatgtgccactcggattaatcacttttggccttgtttggttctttttgcaagaagatcggcgtcaggtacggcaaccgttggatatgcgcggtacggtctggcttttggttgcgttgttagcactgatgtacggattccagacgcttgctgaacccaatgcgatttggcagttagcggggatggcacttattgccgttgttggcttttggcgtttttggcaggcagagcggcgggcagttgatccgattattgatctaaaactctttgaaaatcgcacgtttatcattcataacttgattgcggcgttgatttcagggtttgtgattgggtttgaagtttatatgccgatgtggattcaaggcattcttggtatggatgcatcgcttggtggttttgccgtaacgccgagttcgttgatgtgggtggtcggttcgttttttgccggtaagttactgggacgttttcaacctaaaccgattctgacaggggccatgttttggctgcttgggggaagcttggtcttagcgttggtgccacagtcaacgccgtattttgttttcctactggttgctggctgtcttggcttgggatttggcttggtcattacgatcacaacggttacagctcaggcggtggtcagccctgatcaagtgggtgtggcgacgagttttaatacgttatcgcggacgctggggcaaactttgatggtttccgtttatgggatcgtgcttaacttgcggctgactcaaggcgtggcggctgatggccggctaaacagtaatatgttaaacgaactgatcaatccgcatacggcaaaacagttaccggctagcgttttgccaacgttacgtcaaatcctttatgaggggctgcacaatatttacttcttttcaattgtgattgtggcgctcgctttggtggccaatcattttgaagccaaaaaggttttagcaaaagcggccgcgcaagaatctgatgaagaagcttgaactatgaagccggtagttacggtagccattcgtttgagccaaagtttttctaatcaagccgttgtattattgagcggacgggcataaaaaaatcggccttagagaacgtcaattcgtttctctaaggccgattttgcatagcagcgttcatcatcaagcgcgaaaagaggtatcaatcatttcagcaggttatcggtcgtttgctgattgatcgcggcggacggtttaatcggctgtttatataatttagcatttttttcatttacgacggccacgacatcatatgtggggtcattttcaaggggcccaaaatttagcaaggtttgctggtcatcgtattgaatgtcttgaaggcgggtactcatgaggacatgaagcatgtcggctttttgatgcgactttttgatttcttcactggctttagctaaggtataaccttcatccagcatggttttgatcatgacaattaacgcaatattggacagcgaataacgtttgttgccatttgcttcgtggcgacgtgaatgaatcaggtgctttttttcccaataacgaatttgggtaggggttgcaccggtgatacgacttgtttcgccgatgcctagtgaaatatcgagtgatcgcaaccgcttattaaacagttccatgaaaatctctcctctgatgagcgtgcgccgggaagcacgttatggtgagcgtgaaccagacgaattttgctaaacctgaacccgctgcctttaaaaaatatgcagcgactttcaaatcacaaccttgacaactagttagtttaaatgtaatataatctcctgtcaatattacattatgtaatattaaaagtatgaaacattataaagaaatcaggcgaagttatggacgttaaagatatcaacgggaaacctgtgaacgtaccgatgatggtgattaccctcattgtcgggacattcatcacggttcttaatcagacaattctctccaccgcgtttccaacgttgatgaaggcttttgatatttcaaccgcaaccgtccagtggttgtcaacgggattcatgctggtaaacggtattatgattcccgtttcggcttatttaagcgcaaaagtcccatcaaaatggctctatatgagtgccatgagtactttctttgttggcacgctggtggcgtttgttgctaatagttttggcgtcttattagccggacgattgattcaggcgatcggcgtcggaattaccatgccgctgttacaaaacatcatgatgtcgattttcccaccaaatcggcgtggagctgctatgggaatggcggggatcgcgattggggtggcgcctgcaatcgggccgacactttccggctatgtcatcgataatttcggctggcgggttttgttcggcatgatcctgccaatcgcggcgttggtgattcttgcggccatgttctttttcaaaaacgtgttaccactttcgaatccgaagctggatgtgccgtcgctgattgagtcgtcaattggatttggcgctttgttgtacggcttttctgaagtcggtaatgacggctggggcgatccaatggtccttggttccattgctgtcggactcatcttcattgtcatctttgggtatcggcagttgcatcttaaggagccgtttgtcgaattaagagttttcaagagtaagatttttgcgttatcgactgctttagggacgattgccaacatggcgatggtcggcgttgaaatgattttgccactgtatctgcagatcattcatggtaaaagtgccttggaatcaggactaacgctgttgccaggggcgcttttaattgccgtgatgagtcccgttaccggtcaggtttttgatcgcattggggcaaaacgcttagctcagttaggtctcttcttcctgacgattgcaacgttgccgtatttcttcttaacgacgaatacgccgtcaatcttcattaccgtgatttatgcggtgcggatgtttgggatttcgatggtgatgatgccattgaccaccaacgggatgaatgcactgacacctgatatgattcggcatggtaccgcggtgaataacacggtacgtcaggttgcgacttccatgacaacggcggttttgatttccgtgttgtcaaatgttaccaacctcgccaagccggctgccagcttgttgaagcgcaatcctttgcagtataagcaggacttcctcaatgcaacattaaacggttaccacgcagcctttttattagcagttggctttagcttggttggctgggtgcttgcattcttcctgaatagccacgccatgtcacaggaaatcacgattcaaccagaaaagaaggtgaaggcatgattctttggttcttaggtctaatggtcattggcctttatctcagtttcatcatgatgcatcgatcggcaaagcggagcacgttaattgccattttcagtattggcttgatgggcagtctgttactgatggtgcttaacgataacgcccattttggaatggaaaaacgaacgactacggatgaacaaacgatttatacggcatcacccaatgcgcagatgccaatgttattgaagcaaaatgttggcactgccggtaagcatgttgtctacatctataaaactgatcctaagaaaaaagcggtgcataccaaagcagatctggccgtcagcaatcaggttgtgcagacgacaggaacaacggcttcgatgacaagtcgcacaactcgctgggaatatcaaaatagctttttcagtgcattgtttaaccaccaaggtgcaggccaattggtggcacagcataatcgactcgtggtgcctaaaagttgggttgagctgacgacgacgcaagccaaacgtctcggcactaagctcaaagccttgcaacacccgactgctcagcaaaaagcaaccatggctgccgcggtgaaagccaaagctgctgagttggctcaagcaaatccgaaactggcgagcgatcaggcggcactgttgaaacaagcacaagcagcggttcaacaagcaatgattcaacaggcggttaaagaagttcaacaacaaaaataaccggtccgagttaatgttgatgacgatgcgacaatcaaaaagcagatatcagccgttaaagctggtatctgcttttttcatggcgctgatgacggcgggagaaatacgggctaaagtaccaccagctgagcattaataaggcaaacccgagcgcaaagcctgcgaagacatcggttggataatgaacccgcacaaaaattcgcgaataaccggtcaatccaatcatgccgccagccaacaaagtaatcatccatttaatcgttggtcgcctgacaaaagtccatgctaaaagaatcaaggttccataaaacatcatcgtgccgcttgaatgaccactcggaaaactgaacccgccagcctgtaccaaagcgcgaatttgcgggtcggcgatgaatggacgcggtcgctggactagatatttaataccaatatttaaaatccccatcatggcaccgacactagccgtaaacaaagcggcgatccgataacgatagatcaaaagcacccctgctaacccgagcgttaaaaaaatcagaatgctcggattgccgagttcggtaacggcgatgaggattggctttagcgcatccacatggaaccgggtcacaaatgcgatgacatgctgatcagtcgtttgaatccagcttgcccgattgagaatgccaattaagaaaataatgaagatcataaaagcagtacctgaaaaataaagtggcaatgaccgacgatgcaacaagacaacctcctgtaaacgtaaattgataaccgactgaataccgtttagtcggcttttggtcaatccacggtgacgcgttgacgtttccgcagattgacaaagaaaataactaatatgactagaatagcataaagaccattgaacactttcatggtttttgctatgattgacgcaatcatcaaacgaacaaaggagtagtaagtcggcgcgggtttcagagagcaggcggtggtgcgagcctgacgatgctaagactgaactgacctttgaagttgctgcggtgaacggagtaatcgcagccggccggaccgttaccccttttgagcgctgtgaaagcagaacttaggtggtaccgcggctgagccgtcctaatgaagactagggcggctttttgtttgaaaataagtgggaggtaacaaaatggcatacgatcatcatgagatcgataagaagtggcagcgttattgggccgaacataacgaattcaataccacgaccgatccgaagaaaccgaattattatgcattagacatgttcccatatccatcaggccagggcttgcatgttggacatccagaaggctacaccgcaaccgatattgtggcgcggatgaaacgaatgcaaggatttaacgttttgcatccgatggggtgggatgcattcggtttaccagctgagcaatatgccttgaataccggtcacaatccccggacttttactaagcaaaacattgaaacgtttaagcgtcaaattaatagccttggtttttcatatgattggaaccgggaaattaatacgaccgatccgaattactacaaatggacacaatggatttttgaacaactgtataaacatggactagcgtatgaagctgaagttccggttaactggagccctgatttgggaaccgtagtcgctaacgaagaagtgatcgatggtaaaacggagcggggcggttttccggttgttcgtaagccgatgcggcaatggatgctaaagatcacagcgtacgccgataaattacttgcagacttggatgatttggattggcctgaatcaatcaagcagatgcaacgaaactggatcggcaagtcaaccggggcgcaaatcacgtttacggtcaccgatacccaggaaaagtttgacgttttcacaacgcgtccggacaccctttttggcgcaacttatgtcgtcatggcaccagagcacgacttggttgaaaagattacgacgccggaacagcaggcagttgttgatgcttatattgaagaagcagcacataagtccgatcttgaccggacggcgctcgataaggaaaaaaccggcgtctggacgggtgcttatgcgaccaaccccgtcaatggcgagaagttgccgatctggatttcagattatgtactggcaacttatggtaccggggcaattatggcggtgccggcccacgatgatcgcgactatgcttttgctaagaagtttggcatcgaaatcaaaccggtcattgaaggtggcaacattgacgaggcagcttataccggcgatggcgtgcacattaattccggctttcttgatggcttaaacgaacaggatgccattgatcggatgatcgcatggctggaagataaaggcattggccaggcaaaagttaactataagttgcgtgactgggtcttttcccggcaacgttattggggcgaaccgattccagtgattcattgggaagatggcgagacaaccctggtaccagaagatgaattgccgctgactttgccggaagaagttgatatcaagccaagcggaaccggtgagagcccgctcgccaatttgacagactgggtcaatgttgtggacaagaatggccgtaaaggtaagcgggagacgaacaccatgccgcaatgggccggttcttcgtggtacttcctgcgctttgtcgatccacataacaaagaggccttggctgattatgacaagctcaagcagtggatgccagtggacctttatatcggcggggccgaacatgccgtgctgcatctgctgtacgcgcgtttttggaatctgttcctttatgatatcggtgcgattccaaacaaggaaccattccagcgcctgtttaaccaaggcatgatcttgggtgataatcatgaaaagatgagtaagtctaaggggaatgttgttaaccccgatgacgtggtggacgaatacggtgccgatactttgcgcctgtatgaaatgttcatgggaccgttggatgccggtatcgcttggtccacagatggtttggcgggtgcccgcaagttcttggatcgggtatggagtgcctttattgatgatgaaggtaaactgcgcgatcgtatcaccaccattaatgacggtcgtttggataaggtctacaacgaaacggttaaaaaagtaaccgaggactatgaggcgttgcattttaacacggcgattgcccaaatgatggtcttcatcaattcggcgcgcaaagacgatgatttgccgctagaatatgttgaaggctttgtcaaaatgctcgcaccgatcgcaccgcacttgatggaagaaatctggcaacggctgggacatgatcacagcttaacctatgcgccgtggccaagttatgatgaaagcaagcttaaaaccgacacctacgacatgatggtgcaggtcaatggcaaacttcgtggttccatcactgcgagcgttgacgagactgatgacgagatcaaacaagctgctttagccaatgaaaatgtccagaagtatacgacaggcaaggatattaaaaaaatcattgtcgtaccacgtaagattattaatatcgttgctaagtaatgtggttgcattttggtcagactgataggataagtttgattgccacaattgcggttctagagacaaaaactgcctctggaatcgcttttttggtgagcgcgagccggcgcggttagaaagtaagcgtgagcaagcccgcttagaagccggagtgtaagtggccttgggcgtgatggccggtctttggccattgcgaccaaggtccttacacgcaggcttctgggctggcaagcgcgttatgggcgtaaaccagaatataagcggcctcaggcgtgatggccggtctttggccattgcgcctgaggtccttacacgcagatttctgggctggtgaacgcgttatggtgagcgtaaaaagctggacagtatcggtcgggcagaagagcatcttcccaattttatgacttttatcagctagtaaaagtgtcaaattcatcttgtgaagacatcgggttcatgacgcaacgtgtccattatgtgaaggcaatggttcagctcacgtgaccacgattttcaaagatttcttttgattcaacaaagaaactcagtaaagattgcaagtgaggctgggattgcctaaaatataaaggattacgcaacacgacaggagcttatcatggaaaattcgctgggcggcgggacgcaaccgccacgttcagacaaggaaaaaatgatccgcggttcggcgtggatgactgccggcagtgttttttcgcggattcttggtgctatttatgtcattccgtggcgtatttggcttggagcggcttttttaacggctaatgctttatttactaaaggctatcagatttacagcctgtttttgattatttcaactgctggtgtgcctggagcggtttccaaacaagttgcccgctataatgcgatgggtgaatataaaaccggtatgcggctcttttatcacgggacatttgccatgttcattatggggattctgtcttgtggggcaatgtggttgctagcgccattgctcgcagcaggggatgcccggatgattccggttttccgctcgttggcatggccactgttgctgattccatcgttgagcctgattcggggctttttccaaggctataacgaaatggcgcctagtgcgatcagtcagtttattgaacaggttgcccgtattctgtatatgcttgtcatgacttatgccatcatggttgccggtaaccatgattacctgaatgcggttgtgcattcaacctttgcggcattcattggggcagtttttggacttggcttattggtcgtgtattttgttcggcagaaaccgcgattggatactttggtggcacaaagtaaacaggcgctcaatatcagcgttaacgaaattttagttgatgttgcgcggcaggcgattccgttcattatcatggattcaacgattaatatttactatattgttgatcaatacacgtttaatccaatgatgaaggcgttctacttagttagcgaagatcagcttgatcggttctatgcattatttgccggcaacgccaacaagctgatcatgatcattgtcagtcttgcagtggccatggcaattacggttgttcctttgctggctggcgcaaaaacgcgtggggatgttgaaggtttagcacggcaaattacgaacacgttgcagcttttcttcatcgtcatgattccatcggcgttaggcatggtggccgttgcgcgtccgttatatgttttgttttatcgtgatatggacttccttgggattcgcttgttacaattttcgtcaattttggcgattctcctaggattatttacggtgttggccgctattcttcaagggttgtttaataatcgattggcgattcaggagatgctggttggtctcgctgttaaagtcattgcgcaatggccgatgatcttcttctttaatgtttatgggccggtgatggcgacaatgttgggcatgacggtgtctagtttgttgatgttgtattcgactaatcggatgtacaatattcatgtcagacagaccattcggcgcggcgtcggtattttagctttttccctgattatgtgtgcggtttgctacttgatcgtggacgtatccggtattctcattaaccctgagagtcagtttggcgcagcgtttgttttactggtagcagttggttttggcgttttgatttacggttatttgattttgaaaacacgtttggccgatatgatcattggtgcacgggtcagtcggctgcgcgaaattttacacatccggtgattttatgcgattagataaatatttaagtcatttacagtttggtagtcgaaaagaagtcaaagccctgattcgcgacaagcgcgttcggattgccggtgagttagtgacggatccgggctacaatattcttccgggtgttgccgttgaggttaatgatgctcaagcagacgggccacttgaagtcgattatttaatgaacaaaccggctggcgtcatcaccgcaaccgaagatccaacgcaatcaacggtattggacttgattcgaccacatgattatcggcccggcctttatccagtcgggcgccttgataaagatacaactggactgttattgctcacaactgacggcaacttagggcatactttgttagcgccaaaccaccatgtaccaaaaacttatgctgctaagttagccaaggcacttacaactgagatgaaacaccagttagaacaaggcgttgctttaaaagactttacgacggcaccagctgacgttcaggttgtaccggcgactgacaataaagaaattcatatcacgattacagaaggcaaatatcaccaaattaagcggatgctgctggccgttgataatgaagtcgtcgcgttgacacgaattgcaatgggaccattacgtctgcctgaggacttagacgccggtgagtatcgggcactgacggatgatgagcgttcgctactggatcagatggtacgctaagtttaatctttactttttcgttaacggatccattgtcagggcatagttgtacccctatactgatagacaagaaagggtgagcgcaatggaccaacaacaatatatttgccccaaatgtcaaaatacaagctatatctcggatcggtttcaggcaacgggcggtaatttctccaaaatctttgatgttcaaaacaaaaagttcgtgacgatttcctgtacccgctgtggttataccgagctatatcgcagtgaaaccagttcggggatgaatgtcttggattttctattaaatggcggttgattttgaccattttgacggtagcgtccgtgaaatatcattaagataaacttggcagaatacataaaaacgtccttagaagcacgaaattctaagggcgttttttggctgtcttgattgacattatttaagttgttaattcgctgatacagataattgtttcagataggctggtagctcgcgaatgaccatggttggtaaggcgacgtagctattcatggccacgatgtctgctacgtgtgagtgaacaaagaccgcggctaacacagcttggctcaaaggatggaattgtcccgcaaaagcagcaatgatgccggttaaggtgtcaccggagccgccagttgccatggctggtccgccagctgtgttggcatagatttcgtgtccgatgaatacatgcgtttgggcacttttggcaatgatgattccagggatttttgcggctgcttgttggctggcttcaattgtttgcgctgcgagtgccaagccggagagacgttgccattcgacttgatgcggtgtccaaattagctgggcttggggataggcgaggtgatgggtggctacaagggtaatggccgagccgtcaataatgagcacttgggtttgactaacggctgcaaagacacgctttaaaattttcaaagcagtcgtgtccgtgcctaatcccggtcccacaacaatgacggtcgcttgatggatcgctgtctccagtgccgaagtggaagcatccagaatcatcgcttcaggtaagcgggcgtgtaaagcgctgcgattgacaggatcggtcgcaacactaaccagtccggcaccggcgtaaacagccgcactggcactcataattgctgcaccaccatattgcgcattaccgccgatgataaggattttaccgaagctgcctttataagtattccgtgatcgcggacgaacaatggcacgcgctaattgttccgtcagttgtttcatggtgtgggcacctcttttaaaaccgtccagtcattaaatgtttgcgtggataaattcggggtgccggtttgcaggtagtctttggcaaacatgacaagtggtgaggcgttttcccaagttaactttgctagcggcagggcacatgcacccagtgagtcttgacctgtaaactgtgggactgacgatgccaactgtccaccggttaacgtcaatgcataaaacacgcaaatatgttgattaatcgtccaacgttcatattgccacggataaacaaagctggttgcccctaactgtcggtcgatcgtggcagttaggccggtttcttcgctaaactccctcaagacatcatgctcaagtggttcgggaccatccaagctgccaccgggaagatcgaatcgatgaatatacggtccgccatttttccgaatgacgatcaagcgctggtcaatggttgcaatgccataacagccaaacgcgcgatgggttttatgtgtcattgtctcgcctccatcatttaagcgtagcacggagagggaggtgagacaatgagtacttggcttgtcccctttttgtccccctgaaaacaaaaacaaagccctcctaagataacctaggagggctaaaacgttgatgtataggcatttcattttctaaagaaggctaaaatatcctatgaaatgccgcgaacaggaatcgaacctgcacgggaataaatcccacagcgacctgaacactgcgcgtctgccagttccgccatcgcggcaacaacaataatgattatagcggatgcgtagaaggggcgcaagcaaaactttaaatatttttccgggttgtccgattcaaaaaatgttaggataaagcaacgtgattatttgagaagggtggtagcatcatgtcaatttacgattttgaagtaacgctagaagacgggtccaagtattcattgaataaatataaaggccggccgatgctgatcgtcaatacggcaaccaaatgtggttttgccccgcagtttgacggtttggaagcattgtataaaaagtatcaaaaagcaggtttgatcgtgttaggatttccatcaaatcagtttaagcaggagctggcggatggacatgctgcagcagaggcatgtcgaatgaagtacggggtcagctttccgatgcatcaactgatcaaggtcaatggtcagcagacggcgccgttgtttaaatatttaaagactgaggctccaggcgaattgggtaagtcgatcaaatggaacttcaccaagtttttggtcgatcgcaatgggcatgtcgtgaagcgctttgcacctaaaacaactcctgaagcaattgagccagcggttgaggagctgttatcctaaggttttaaaaggattgccggatgactgattgggtacttgatgacggtggacatggttctactggatgcgtacaatgacaacaaaagcaagaaagcagggatcattgatggaagatttgccaactgatattgcaacgtttgtggacacgcacttagttgatcgtcataatagcaatgctgtgaagtgggacggtctgaaagaagaatttggccgggctgacttgttgcctatgtggattgccgacactgagtttaaggcgcctcaagcagttttggatgcattgacagctcgcgtcaaggaagggacgtttggctattccattcgcccgcagtcttattacgaagccttcattaactggcaaaaggaacgacatggcattacggttgaacctgagtggatgcgttttggcgttggcgttgtcaaatcactgtatgcgatggtgaactggctgacagaacctggtgatccggtcctcatcatgcagccggtttattatccctttatgaatgccattaatgatcttggacgtaaagtcgtatcagttgacttgcaattaaccgctgatggttggcgcatggattttgaccaattagaaaagaccttggcggcgaatgaaattaaagcgatgattctgtgttcaccgcacaatccggttggtcggatctggacccgagatgagttagaacaactttttgccatcacaagtcggtatgatgtgacagtggtttctgatgaaattcacggtgatcttgaagtgagtgggccgaagtttacatccgctctacaggtcgttgaaggtaaagctcgaaaaaagcttgttgtgctcaatgcgccgtcaaaaacatttaatttagccgccttgctgaattcacacattattattcccgatcaagcgttgcgtacgagttatgatgccttcattaagcagctgcatccggttgatacgagcttgatggggcaagtggccggtgaagctgcttatcggcatggtgctgcttggttagatcaggtcttacaagtggttcgctacaattatcggcaactgcaagctggtttagccgcggcggccccacaagcgaccctggccgatttacaagggacttatttggcttatgttgatattggtgcttatgttgcgccaagtcagatcaaagactttgttgaaggggtgtgcggattggccgttgattatggtgcatggttttcacctcaaacggcaacttatattcgtttaaatttagctactgatcctaagcttgttgccgaggcgattaaccgattaaccactcatttggcacagcagccgcagcggtgatcgggacaagagttaaattgcctttttcaagataaaactcgaattcaaagagacggaatggttctccttgaatccgagttttttaatattgtgctgcacaaaccagtttacttgatatgggacgtgttatcgaagcttgaggcgtaaatactgatcgcctaaattgtgatcctgaacaatggttttcagatatcggcgtaacatggctgaacgttcaagcacggaccaaccggggtcggcatgcaaccgtttaagttcagcgcgacttggatgatcatttccggtgaaaaagcgccaattcaaaatacccattaatctggcagcggcgtcaagatcacgctgattggtcacattattgtccattaaatcaccataggctaacgcttcaccatcttgcagaaataattttttcaagtaacgctgatagtgcaaaagatcaggattttttcgctgttttgcggtgagataaggggtcaggttggtgatctgtttttgataagtaatttgctggggaccaaacgtgacgaccccataactagcgggactaatagaaaacgcaccactgacaatttcgatagtcgggcactggccagctgggtcgtggctgatgtcttgtgcatgaatatgcccggagaagactaagggcacatgatagcgggttaataacttttttaacgcgtcactattgtctaaaacataaccttgattgacggcttcgttatgcgtgtatagattgtgatgcatgaaaataattgacttgcgatgcgcgcgggcacccagcgctaattggcggcgcacccaggtcatcgtttgcggagaaagcttaccacctgtattaggcggacgattagatggctcaatcgtgtaaatgttgctatctagcagtaacaattggtattggtgattgagatttacgcgataacttagactgttcccatcttgggcagcagcttgttcataactgctgtggaagatctggcgccagtcgctggggctaatttgttcagtcaggcgttgttggcgtcccttataagcgcgggcccaaccgtcataaatatcatgattcccggggatgattaacactttaatgccatgggttgtagtcggtgcattaagctttcagcactggttttctcaccgttaaacgtcacatccccagtgatgattaaggcggttggccgtgattttaaggcgttttgcactaatgcatgaatggcaactggttgataatccatatctttacccgcggctgatcgtttgatttgggtataggcgctgcgttcatcgtgcaagctaggcgcaataaaatgcgtatcactaagcacccagatgcgtggatgggcatcgtcagttaacggcgtttgatgatcagggtggacttgggttaaccctaatgcgagcaggaacataccaaacagtgctaccaaatatttaccgactttcattttctgcctccaaagttaattctaccatgataaaagaccggcgctagattgacttatttaggtataagcattaattgccggatgcgaatttgggagtgggggactgcgggcagttgttgaaaatcttcgcagcttacttcatcggttatggtaaaataaagcatcgtttcaccgtatgaaccaaaataattgtttttaaagagaggaaagaagcatgcaagtcatcgtaaccgttattgggacagataaggtcgggatcatagcgcaggttaccactgcactcgctaatttagatgttaatatcttagatgtgtcacaaaccattatgcaaggcgcctttaccatgatgctattggctaaaattccggatgatgccagtttcaaaactgttaagcaaaaactaacagctttaggcgacaaaatcggtgtggagatcaaagtttcccgtcaggagatttttgacgcgatgcaccgtctgtaagctggtttagtcataacgcgttcgccggcacagaagtctgcgtgtaaggaccttaagcgcaatggccaagagcgggccatcacgcttaaggccgcttacactccgacttctaagcgcgccggctcacgctcacattaacgcgttcgccagcgcagaaacctgcgtgtaaggacctgggtcgcaatggcaaagtgcagccatcacgccccaggccgcttacactccggtttctcccgcgctggctcgcgctcactataaaggagtagcttgatcatggagacgcaacaaattaaagaaacaattgaaatgatcagtgaggaaaatctggatattagaacgataaccatggggatttccttgctggattgtgtgacgggtaatttacaaacaaccgctgatcatgtttacgctaagattatgaaaaaggcggccaatttggtagcggtggcggattccattagtgatgagtatggcattccgattgtgaataagcggatcagtgtgaccccggttagtcttttagctggggcggatcaaatgcttgattttcggccggttgcctatgcgatggatcgtgccgctaaggatctgggcgtagatttaatcggtgggtattcggcattagtccaaaatggcagtaccaaggccgaaaccgcgctgatgaagagtttgccggaagtgttagcaacgacagaacgggtctgcgcttcggtaaatattggcagtactcgtagtgggttgaacatggacgccgttaagttgatgggaacggtggtcaaacaggtggctgatcggaagccgcaaaatgccatgaaactggtcgttttttgcaatgcggttgaagataatccgtttatggcaggagccttctgggggatttcagaaggtgatgttgcgatcaacaccggtgtttccggtcccggcgtggtacagcgcgcactcgccgctgaaccagatgctagttttgaacaagtgtgcgaaacgatcaaacaaacggcatttaaggtatcacgaatggggcaatttgtcggaaaggttgctgctgatcggctaaaggtaccgtttaatattgtcgatttaagtctcgcaccgacgccggatcaaggtgattccgtcgcccagattttagaaacgatgggtcttagccatgttggcacgccaggaaccactgcggcactcgctttgcttaacgatgcagtcaaaaaaggcgggatcatggctgctgaacgagtaggcggtctatccggtgcgtttatcccggtttctgaggacgccaacatgatcacagcagcggctaatggtcaaatcagtttggaaaaattagaagcgatgacggcagtttgttccgttgggttggacatggttgccgttcccggtgatacgccggatgcagcaattagcgggatgattgccgatgaagcagcgattggcatgattaacaataaaaccactgcagtgcgcgtgattccggtacccggtaagcaagtcggtgatcaagtcgaatttggcggcttgtttggaactgccccgattatggcggttaatgatggggatgcctgtcaatttattaatcgcggcggtcgcatcccggcaccaatccatagctttaagaattaacccgctactttaaattcttagcatggaagcatttctgatggccggtttatttttttaataacgtactttgcaattgcattcgaaaaatgtcttgcccggctcatgttttatggcggcgcaaggcatttttaattgacggcgtaatctattcatgaggtgagaatgatgtttgtagctttggatgaagaaaaccggcgagtcatattaaccagtcatgaacaggcgcaacaactacgcaaccgatcgttccattgcccaatctgcaaacaacgcgttttgattaaaaatggtgtggtgatgccggcacattttgctcatcggcagcgatcagacaatgaaggagaaccggagagtgtcgaacacctgacaggtaaaagttggttggtaacctggcttcgattgcatcagcaggcggctacgttggagtactatgatgccaacattcggcagcgggcagatattcttgttcaccgtaacccgccaaaagtattggaattccaagccagtccgttaagtattcctgatttgaaaaagcgtaccacgatgtatcacgctcgtgggtgggaagtcacttggattttaggacgtcggtatcagcataaccgtggtaaaagacaggcacgaaagtttttaacgttggaagacaacttattgacattgtggtatctgaattcgcaagctggcaaacttacacgggttcagctgatgccaactggacgtctattgacttattatgttcagcggtgttctcctaaacaatgttggcaaccggaactggtagatgggttgcgtcaggctaggcatatcggtttgtctttacaaaagcgggtaccttcatggatgacgcttcaggcgttagcatatcagcagcatcataacttacacggggttccatggattgtgcatcaccgttcacatccgctgcggcattttggcatcccggaattactgttaagggttaaatggttactgacgtttgaagggcggacgtttacggatcgcgacaatttaaacttctggctggcggcgctaccgaatgtctggacgccgttgttgccagcaggaaccctcggcacactaatcggtaaacactgggtggaactgctacaaacagctgggtttattcggcgtgatcatttggggtatcgttggcgtcagttaccgcactggtttacggatattgatcacaaacttgttgctcgatcatgcatcgccccaagcgcaaagccctgagagaaaggactcagaagcaataacgacgatgggacagcgcggtcaattgcttcgttaactcctaaatgcgccggtttaagcgtaaaaaagaccctgcataatcgcagagcccgctaaaaaacagtaaattttaggttatttgatgttgccgctagcaaaaaggctgggttgaaatccaaatacaaaggttgcttcattcagacgaagactaagtgttggtgaaatcacagttgcccatggttagaaaaatcggaaatgactgcccatgttttctggtcgctcagtaaagaagtgggatggatcggttcgaatgagctcgcaaaggcggggaataagatcaggatcactaatctgttcaattaaaacggcatgcccatcatcaactttgcgatcggtatcgacaatcaccaaagatggggtttgggtaatgcccatttgattagcagtgcgttgatcggaatcaaagcccattttgacttctgaccgttgtcgatcttcgtaaaacatctcatgatctaagtggcatttggttaacattttcgctacaaacgctgcatcgtattgatattgaactaaaggcgcgtgctgttgtagtcgtaacagcaacatcctggcctttttgtttccttgatattgggcagctttgtaatctaaagcaagattataagcagctcgcaataactggttgcgtttggcgaggctgtgaacatttaattgttcgcactgcataaactgttcgataatatccagatttaaaaccggaacaaagtgaactttgacttcctgttcgaatttgtccaactggtgtagcaacttttgttcggtgctaagacagacacttccaataggattgaaaaaaagaaagatttctaacacggtcatggcctccaatttgctggcaacaaatttctatacttactttatcagaaaaccgaaaagtaacaattatttagcttgtgaatcgtgcacatgcatgtatgcacgttgcaccttattaataacgggttgtttttttatgtgaaaatggcgtagtaaatcatcgtaaaatttttgcgctacagcaagattctgatactccatttccagttcaaaatcagaagtctggtcgatataaaaggtctgatcgagcgttaacaaaccagccggcaaatgggcaagtcttctggttgtcttggcttgggtttgaggagcaaccgttgccggatcaatcccccgggcagccagagcctgagtcacttggcctgatttgagctcaccttgttcgattagtttctgtgcctccactaaactcaatggatcggtgatttcttctaagtcgcgctgggtactttcattaggcactttaagggtttgttccgcatggtcggcaaactgacggatacgcaaaccaagccgcgctgctttgacagcaccgtcagctgtgtcataataggtgttcatttggctaaaggccggttcaaaatcaaaatgattcaaaagtgctaagaaagcatttttgcttaaacaagttttgaattcctgctcgcgggaaatagacatgatttgcctccagaaacaacggcaccggttacatgccaaaaatatgatagaatgatggtcgtgagtgtcatatttagccaaagtcaacatcacgtttagctgacgtggtgacgactagccagatggacatcacattatctagtagtttagtatgggagggccagtaatgcaaagggactgggacagtttcttaatgccatatgaacaagcggtcggcgaattgaaaatcaaatttcgcgggatgcgtaaacaatttcaacaggcaaacgagcatacgcccattgaattcgtgacggggcgggtaaaaccgatcagttcgattattgaaaagcaaagtcgacggtttatcagcgatgagctcctggaacaagacatgcaagacattgctggcctacgcattatgtgccaatttgtggaagacatttaccaagtggttgacttgttgcggcagcgaaccgacatgaagattgtggaagaacgcgactatgtgaccaacgtcaagccctcaggataccgcagctaccatgtggtcatcgaatatcccgttcaattgattcatggtgaaaaaaagattcttgcggaagtccagattcgaaccatgtccatgaatttctgggcaacgattgagcatagtctgaattataaatataatggtgagttccccgatactttgaaggcgcgactcaaacgcgctgctgaagcgtcctttatgcttgataaagaaatgtcggatattcgcgaagaaattcaggaagcacaacatttatttgtctacggtaaaggccaacagccgtattcagatacaaccgatgactcaaagcctgatgataaaaaggatgaataagatgcgtgtgacagtttttcataacagcatacctgcttcaattaaagcagcgcagaaactacttaagttattaaaaaatggccattttgaactcgatgagcgccatccccaagttgtgatcaccattggcggcgatggcacgctgctgtcagcctttcaccggtatgccgaccaattggatacgattcgctttatcggcgtgcatacagggcatttaggcttttatacggactggcgtgattttgaaatcgaggatttggtcattgctttaaaagaagactccggccaaagtgtcagttatccgctattagatgttcgggcgatttatgcagatgctacgagtgcccattatttggccctgaatgaggcaacactgaagcgtctgaatggcacgatgcggacagaagtttatattaaaggcgacttttttgaaagttttcgcggggatggtctgtgcgtttcaacgccgaccggatcaactgcctatagtaagtcaaatggcggggccgtgatccatccgcgccttgatgccttacaaattacggagattgcctcaatcaataaccgggttttccggaccctcagttcaccgattattatcgcaccagatgaatgggtcactttggaaccaaccgggcgggatgattatgtgatgacagttgaccagtttgtgattaatccgccgacgattaagcagattcgttataaaattgcaaaagagcgcattcactttgcccgttatcggcacatgcatttttgggaccgtgtggaggatgcgtttattggagcaaaacattaatgcgatttgaatggcaatacgagggaccgccgctcaaattggcggcttttttaaaacaacagggtttctcccgggcccaacttaaaaagctgcgttatcaaggcggctttatttttgttaataaacggcagcggcatacagcttatccgctgcgaaacggcgatcggattctggttcaaaccgcacctgagcaagccgccgctagtgttgtcccatatgaacatgagtttccgatctgttatgaagacgatgattacttggtcgttaataagcctgctggggtggcatcgattccagcagttggccggcgaaatgacagcatggccaatatggtcaaggcgtatttgattaagacccatgcagaaagtcaggcagttcatgttgtcacgcggctagatcgcgacaccagcggcttaatggtgtttgctaagcatagtttggcgcacagtttgctggatcggcaattgcacagcgagaattttttaaaacagtacttggcgctggtgacgagtaagtcattgctgtccgcacatggatggattgtattgccaattggtgtcagcacaggattttatatgcgccgtgtcgtcagtgaaaccggtaagccatctgtgactgaatatcaaacacttgcgcaaaattcgcacgccgccgcggtactggtaacgttacacacaggccgcactcatcagattcgcgttcattttgccgcgatcgggcatccgttgtttggcgatgatctgtataatcggcaagctgacgattttaagcggcaagccttgcattgcgcacatttgcggttttggcagccgttgcaaaaaaagtgggtcgatttgcatgcaccgttaccaactgacatggcaaagcttagcgaccacttgcatttaccagttgtttattaggcatggcgtcattgatgaaggggacactggcaagtcgtttggccgcatgaagactgagacatcatttgcagcttctaaataaaagtatcccattttcacgcgatcgcgaaaatgggatactttttatttttgccactgtcaggttaaaaattccctttatgatagccggaatcagcatcgaacttaaattgtttcttgagtccgttagttaagtaaatctttttgtcgttggtgataaagatggcttgaatgtgctgactgtttttggcattcatgtactgtaagccatccttgagccccttgtcaaaagcggcgtttgacaaggcatccccgtccacgctgtttttggaaacaatggtgaccgaggccagattgttgtcgtatgggtaaccggttttgggatcaaagagatagatatatttgtgaccgtgcgagattaggtattgctcatatgtgccggcagtgacgatggattcgttgctttccgggattgtcccaacggcagtaccgcgcgcggctgtcgggtcttgaatcccgacatgccaatcacgtttcgcgccaagtggtgaatgacccatgaccacgacattaccgccaagatcaataatggcggcggtcaccccatctttacgcaagacttcgcgaaccttgtcggcaacccaacctttggcaataccgccaaagtcaagccgcatcccttttttggttaggtaggccgtgttgtttttggtgtcaagcttgacatcgcgccagttaacgagcggcaatgcctgggtgatttcgctttgtgcgggaacacgcgcaccgggcagcccgatttgccagagattggtaacagcaccgatcgccatgtcaaaactgccatttgagtttttggagaaataataggccttttccagtagcggcataaaatcttttggaaccttgacaggcttgataccggcattggcgttgattttatcaagcactgaaccgcctcgggtcaaggtagcttcggcgtcaacatgatggatcatcgcaaaaccatcttttaaagctgactttttgcctttatcgtaaatggtaagcgtacatgttgtccccatgacgaattcattgcgtgtatatggcgtttttagataggtcgcctgtgttttcttttggcacccggataacgttaaaagtcccatgaaagcaatgagaccgatgaatattttacgcatgttacttaaccctcatttcattttaccctttaatatcataacgctcgttttctaaaaagaaaaacgcgattcgccctgctgtgatttagacgaaccgatattagccaagtcaggtttaccatcaacggattaattgggtacattaaaaaggccgacctcagagacgagtttgtctctgaagccggctttttagtgtcttgaataaacaaagaaagttagaaggcgatcagtttggtgccatgaagctccttaacgcctaattgttcgctgatagtagcggcattttggctagtgatgccgccgccgggaagaatcgtgatttgtttttgcgcggcatgggcgatcagtgcctgtagatgtggcaaggttgtttcaattggggttgatagtgggccaccatgcgtcaaaatccgatcaacgtgatgtgcggctagccagtcaatggcggccagctgcttggtttcgggaatggcatcaaaagccatgtggaagacaacactcataccggcgcttgctgcgatcaaactcgtcatggcatcttcatcaattgtcccgtccggcagtaaggcaccgaatgcaacgccatcgacgccaagtgcctgcgcctcgaataaatcggcttccatgatctttaactcggtgtcattgtaaacaaaattgcctccgcgcggccgaatcatagtgacgaggctgcgaccatgttcgtggacatacttggcactttcagccatcacacccttggaaacggtcgtcccaccaaccgccaaattatcattgagttcaattcgatcagcgcctgcagcaagtgccttgggaatgtcggtatagttttcaacagcaatttctcgtaacatggtaacctcctgtcattatttaaagaaacatcacaagtaacacgatggcacccagaatgattcgataccagccaaacggtttgaagtcgtgcgtttggacgaatttaagcagccatttgatagcaacgatggcgactaagaaggacacgactgagccggttagtaacacaacccattgctcgccggtaaagccattgccttgcaacaaatacttgccaatttttaaaattgaaacgccaaccatggtcggaatagctaagaagaaagagaactccgtcgcaacatagcgcgatgtcccaatcaataaggcccccaaaatggtggcgccggagcgggaagtccccggaacaattgacagaacctggaacaagccgattaacaaagcggtttgataggtgatgtcggccaaacttgtaatgtgcgcgtgcttatttttgaggtaattttccaaaacaatgaataaaaccccgtaaaggatcaaagtcgttgcgacaacgagtggtgtatgtagatgtttgtccatccagtcattgagcggtaagccgacaacgacagatggcagcaccgcaatgatgactttggcccataactgccaagtatctttttgcgcctggacagtcggtttggaaaatgggtttaatttattgaagtaaagcaaaataaccgctaagattgccccaaactgaatgacgtattcgaacatgttcataaattgccgtccttgcgacaacttaacgacctggtcaaccagatcaatgtggccggtggagctaatcggcagaaattctgtcagcccctcgacaatgccgataatcacggccttgataatatcaaacataataaccctccaattctcaatgttaacagtatacaaggttttatcctacttgccataatgcaaatgcaatttagcgagatcttatataatctgtgcggtttaggatgaactgatttgtggcaagcaaaaagcggcttaagcaaattgcgttaaagccgctgttaaaagatctgattaaagccgcttttcagtttgaaagtcggctatttggttgccagaaacaaaacgttaacggcttccggagttggaatatcgcgctgttcttcggttagcagcccggttttagaatcccggctgtataaagtcccgttgctggtgttttgattaactgctaagacatagcgttcggtgaggtcgaagttgaagtcacgtggaaaatcgccggcggtactgatttgttgcagttgtgataagttgcgaccatccggactgacagcaaaaacggttaaactattaaagccgcgattagaaacatataggaaccgttgatcactacttaggcgaatagctgcggcaccattatgatccgtataatcttccggaatggtcggtaaggtagcaataagttcaaaacttccggtggcagcatcatagcttaagatgctgacctgactcgagagttccccaagtaaataagcaaccggattgttatgattaaatgcaatatggcgcggaccaaacccgggttcagcgtggaagacaacgggatcgccaagcttgccagcatcactaatcgtgtaagtggtcaaagtgtcattaccaagatcagcgactgccaagcgttgaaaatctggcgtcacggcagcgaaatggacatgggcgccgtcttgttccggacgcggaccgttaccggtgtgcacaatttcgtctgtcgtagttaagctacgatcacggttgatcttatagacgttgatgcgcccttcatgataattgctcgcgtatacaagttgacgattttcatcgattgagatgtgggcaggagaagagccgggttgtaaaacgcgattgatcagcttaggaggattaacgttgagatcataactggctacaccgccttgatccccttcagcatcgaccgcatataaaatatggtcatctgaaacggctaaataagtaggggaacctaaatcggtaatatacggttgcggggcagttaattggccttgtgtgtcgtcaaacgtaccagtataaataccagcaccgccgtgacgggtataaccgcctaacaagagtttttgtttcatagacaaaatgctcctttcgaatttgctttgagtatagcatgttttggggatgcttatgctatgatatagaacgtgagccgccccaacatagctggttaacttgctgccagctgtccttcaaagcagcggcttacttgtcccttttcgaggtacaacaagaccgacaaaaacgaacgtaccgcatcttttttagtactgcgatataggcttaaaaatatcacaagtaaaaacggaggcaacaacatgcaatttacggcaacgatcactgccattggtaaagacgctttaagttcaaaagatcccatgattattttatttggccccgaagccacagatgcactgcgcgatgttgcagtgattcaacagtttgatgatcccgcggccttatcccaattctccattcaggcgggggatcggctgacgattgacgggacagctttcaccatgacttacgtgggccagttagccatcagcaatttgaaggcaatcggtcacgttaccttgttattccaagacgtaccagctgaaaagccaatgcagaatgcgatttatctcaaaccgacccagcggccagcatttcgtgtcggaacaacattgacctataacacgcaagcttagcggttgttaattggatattaaaaaacacctgtaatgacaggtgttttttttaccatgatgccttgcgaacaccgggaatttgacctttgtgagccaaatcgcggaagttcaagcgtgacattttgaatttacgcatgtaggcatgtggccgaccgtcaagttcatcacggctgtgtgcgcgaacaggtgaagcattccgcggcaacgcctgcaaagcagcataattatgctcggccttatacttggcacgcagcggagcgtacttggcaatcgtcgcttcgatctttttttctttggcaatctttgacttcttagccatctatgcaatcactccttgtttgtggtttgtattggatactggtattcgaacagttcaacccacatagcatagcacagcaataagtcactcgcaacacttacaaaagataagcgattagtattgatcaccattgaaaatcgagtttttaacaatgacataatcgaccttggttaaagcttccagatcgcgaccaccggcataggaaacagcggattgtaaatcttcctgcatttcctttaatgtatcgccgatcttacccttaactggcagcaggatttttttgccttcaacgttatgatgggtgcctttttgatactcggaagctgaaccgtaatattcctgatattctttgccatcaatggtgacgtgcttaccaggcgtttcttcatggcccgcaaacaaagaaccgatcatgcacatggtggcaccgaagcgaatggacttggcgatgtcgccattgttacggataccgccgtctgcgatgatgggtttacgcgctgctttagcgcaccaacggacagctgcaagttgccaaccgcctgtcccgaaaccagtcttgagcttggtaatgcagaccttaccgggaccgatgccgactttcgttgcatcggcgccggcattttccagttcacgaacagcttcaggcgttccgacattaccagcgatcacaaacgtttttggcaaatagtgtttgatatgctgaatcatgtcaatgacgatttgggcgtaaccgtgggcaatgtcgatggtcacataatctggcgtcaaatcgttagcagccagcgcttcgataaaatcaaattcttcatccttaacgccaacactgattgacgcgattaaaccgcgctttttcatgtcgcggacaaaatccatgcgccgttctggctgaaagcgatgcataatatagaagtaatcgtgttcggccagccagatcgccaaaggttcatcaatgatggtctgcatattggcaggaacaaccggaattttaaacgtgtgtgggccaaatttcacgctggtatcaacctctttacgtgagcgcaccacacatttgttgggaatcatttgaatatcttcgtaatcaaaaatctgcatgccgttgttcatcggattcatcctttcgcaaaagccgaacattgttaagcattattggtgttattcaaaacaccaagtgctaagatacgcgattaaaatgtaaaagtcaaccaaaatactttcttttctttttaatgttcgtgttttgcttaaaaataagaaaagccgggatatcccggccaggtagcaagtggattagaaaaatttgtttcgccaaaattgaaaggcaagaaccatcgcaatcgcaattgaaatggcaatcgtgatgatccagctcaccttcatatctgctagtggcaagtggacattcatgccataaaatgaaaagaccaacgtgggaatggtcagtaagattgaataggatgtcagaaatttcatgacgccattcatgttattgttaatgattgacgaataagtatcagccgtttcgttaataatggaattgctaatctgcgccatttcaaccgcttgctgattttcgatgatggtatcttccagaagatcctgatcatcttcgtttagatgcaatgggttggtgcgtttgagttgttccaggacattacggtcggttcgcagactcatcataaagtaaaccaaggagcgttgaatgcccattaatccgtaaagttcttcgttgcgcaagttgcgttgaagtttattttcgttggcttcgcgggctttgttgagatcgcgcaggtaggtcaggtaactgatcgaaatctgatacagtatctgtaagacggtgcgattttgatgttgcggattgaagttgctgattttgccttccgaaaaaaggctcagcaacggtatcggttcttcgttaatcgtaatcaccgcgatatttgtaataataatggcaagcggagccgtttcataaaccactttttttcgggcgtcacgggtaacaacgggcatgtcaaaaataaacaagtggctgtcattgtcttcatcatactcataccgtgcgccttcatccggatcaaggccatatagtaggaatgcttctgatagattggctttagtctgcaattgttcccgttcttttggggttgggttgaccacattgatccagacgccgggactgatccgcgattgtggatttagccggccggttttgtcatcgaaacgataaattgaaagcatggcagtctccttggctttttctcttagtttacaacaagcggccaagctatgcaggaaggaaaatcatgcgaaaacgtgaagcaaaaattgaattggcggctcaacaaacgcctttatttgcgtgtccagtgtgcgctcagccaatgcaggtcaaagccggatcgcttatttgttctaaaggacaccggcgcgattttagtcgtaaagggaccgtgaacttcttgaatcaacaagtcgcgactgaatatacagctacgatgctagcagccagacggcgaatgttgacggcgggattgtttacaccgtttttggacgctatggcagctaaattagtcccgcatcaacgcctattagatgttggttgcggtgaggggacaccaactgcttacttggctcaccaaaagcaacagatggcagtcggtttcgatatttcagccccggcaattaacttagcgggtagtttggcagcgccagtattatttgccgtggccgatttggcgcacctaccatttgtcaacgatgcttttgacacggttatcgacattttctcgccaggcaactaccgggagtttcggcgcgtattacgaccaacaggacagctgctgaagattatcccacgcgccggctatttaaaagagctgcgtgaagggttatattctggaacacgtaaggctgaatatgataaccagcctgtgcgtgaacggtttttagcagcgtttcctcaggcaaccattcaatcaataacttatgatttttcactggctgcagatcagtttaccgatttgatgaccatgacgccactgtcttggcaagcaccggctgaacggcgccaggcaatgttaaccaatccaccaaaaagtattcatattgaggttgatttactcaccgtttcgaatcttgtcaagtaaaagggttgaaaacaggaataaccggtgttaatatgcttttaagctatttatttcgggcttttatcagggctagcttttgggtaattgataaaagtttgcgataaattacttcactaacgtatcgcttcgctgagtgcgctccgaagcaatgcgtttttttcttgcttaaaatcaggttggcgccaagtttttgactcgtaacgcgctccccggcgcaggaatctgcgtgtaaggatctgagtcgcaatgaccaagggcgggggacatcacgctcgacgctaagttcacctttacgcctataacgcgttcgccggcgcaggaatcggagtgtaaggacctgagtcgcaatggccaagagcgggccatcacgtttcaggtcacaagtctgcctttactgtcataacgcgctcaccggcgcagaagtctgcgtgtaaggaccttgggcgcaatgaccaagcccgggtcatcacgcccaaggccacaagtccgcctttacgcccataacgcgttcaccggcgcaggaatctgcgtgtaaggacctgagtcgcaatggccaagagcgggccatcacgtctcaggccgcttacactccgattcctaaccgcgccggttcacgctcactgcaggttggtgttaacacaatagaatgtgctacactgaaagcacttgtgttgaagggacgataacatggcgaatcatattgttttatttgaaccgttaattccagcgaacactggtaacattgcgcggacttgtgcagcgaccaatagctatttgcacttgattaaaccattgggatttgagaccgatgacaagcatttgcgccgcgccgggttggattattgggccaaggttcgaattgtctatcatgatagtcttgatgacttcatggcaacggtcaaggatccgcagcatttgtatctcatcaccaaatttgcagatcaaacctattctgatcgcgattacaccgatacgcatgccgaccactatttcctttttggcaaagaaaccactggactgcctgagggatttatgcgggaacatgaagatcagtgccttcgcattcccatgactgcaaacgtgcgcgcactcaatttatccaattgtgcagcattagtggtttatgaagctttacgacagcagcattttgccggactggaaaccgtgcatacctatgaacatgacaaactaaagtgaaaatacgctaggaggcgcaacccatggaagcaaaacgttatccgattacggttgaatcatttcattatgatctcgtgaaacaaggaaccccagtgaagaacgatttacaggtagccatgcgtcagattcagtggtctgaccctaagaaacaggcagaattaaaaaaaggcaatctttttgaaatgatgattccctttgacgtggtgcctgacaatgccggatttgaaatttccggcaagatcacccaaattgttcaggttatggattatttcggtgaagcaaatgagctgccacaagaagaactaggcaaattgagtcggccactggttgaaaccattgaaaccttgacctatcaggtgacagcggtagccttggatcaaggcgttaatcttcagttcggcgcaagcgacgaacaacctggccaagcttaaacaggtagtgaatagggaaagatcaaaaaggcggccggaaagctgccttttttgctgagcgcgagccggcgcggttagggatcggagtgtaagtggcctcaggcacaatggccggtctttggccattgtgcctgaggtccttacacgcagatccctgcgccggggagcgcgttatgggcgtaaaccagaacataagtggcctcagccgcaatggccgggctttggccattgcgcccaaggtccatacacgcaggctactgggctggcgaacgcgttatgggcgtaaaccagaacataagcagcctcagccgtgatggccgggctttggccattgcgcccaaggtccatacacgcaggctactgggctggcgaacgcgttatgggcataaaccagaacacaagcagccccagccgtgatggcctgagcttgcccattgcgcctaaggtccttacgctctgacttctgcgccggaaagcgcgttatgcccaaacatacccctggctaatgtaaaagccgacataacgacacaccgcatatctcaaaagaacgtaacaaaatcaccgcagtggctttttaaatgcgggctcagctcgtgtataataggcaggaatgaaaggagcatgaccatggcacaaaaacgcggcgggcgcaggcgaccgcgcaaaaaacgaccaactaaacagcaacagcacaccttaagttgggttggcgcgctatttgtcgtgttcgcgagcctggcatttttccgtctcggcattgttggaacggtccttgccaacgtttttcggttagtagttggcgatagttttctggtagtcagtgctgcgaccgttgtgaccggtatctggtttttactagcagatcggttgccgaagttagcgcggcatgtctggatcggactaagcatcattctaatcgctgcattggtgttgctaacagcacagacaatggcgacgctgaatgtccacagtcattatttgctagcgacttggcgcctgttgcaaaatgattttgggctaatgacgaccgcgtcacaagtcggaggcggcttgcttggtgcaggactttttgcgttgttggcaccattattaagtagcttaggcgcaaccattcttgcgtggtttggtgttattgccggtatcctcgtgtttttgggggtgggcgccaaccaggtttttaactggttgcaagcttttggacaggcttgcaaacgtggattgattcaggtatctgatcacataacggcgctaagacaagcacatgctaaaaaagctgccactcgtccaacatcgacgccaaaagctgcaacggatgctgctcacacgcaatcagaaccatcatcggagcgagccgatgacttcacgattaaggggccaactccggttaaaccgttgccgcaaagtgaagcgcctgccccgacgaaaccagcaagtaccgcacctatgagtgagtcatctgctgccactgcgcaggtgcccgccagcaagctggactcagacatgccggcttcagactatcagttgcctagcctagccatgctgacggcgacaccgcctgtcgaccaaagtgcagaatatcaggcaattaaaacgaaccgtacaaaactgaaggaaacttttgaaagctttggggttaaggtgggcgttaaaagtgcgacattagggccgtcaattacgcaatatgagattcagcccgcggtcggcgtaaaggtttcaaaaattgtgaatctatccgacgacttggcattggctttagctgcaaaagatattcggattgaagcaccgatccccgggaaatcgttaatcggaattgaagtgcccaatcaacatattgcaacagtcgggtttaaagaggtcatggcggagacgcctaaggcaccgaatcatcccttagtgttaccacttggccgggatgttaatggtcaagtggtcacctttgatctaaccaaaatgccgcacctactaattgccggcgcaaccggttcaggtaagtcagtgatgatcaatgtgatcctgacgagtatcttgatgcgtacgaagccaactgatgtccggctgatgttaatcgatcccaaacgtgttgaattgtccgtttataatggcgtgccgcacttattgacgccagtcgtgaccgaagcaaaaaaggcgccaagtgctttaaataagattttaaccgcaatggatgaacgctaccaacgatttgcggcagcaggcgtgcgtaacatgaaagaatttaatcaaaaagtagcagcaaatcctgccagtggtcagtccaaaatgccgtatatcgttgtcattattgatgagttaagtgacttgatgatggttgcgggtcacgaaattgaaaccgccattgtacgactggcccaaatggcgcgcgctgccggcattcatgttatcattgccacacaacggccatctgtggatgttatcacggggttgatgaaggctaacattccatcacgtattgcttttgccacatctagcggcattgattcacgtacgattcttgacagtaatggcgcagaaaaacttctgggccgcggtgatatgctgttttcaccgattggcgcttccaagccattacgagttcaaggtgcgtttatcccgtctgttgatgtagaacgggttgtgaaagctatcacggatcaagtggcaccagcttatgtagacagtatgacgccgactgaaaatgtcgaaaccgagcaacaaggggattctgaagacgagttgtacgatgatgccaaggcatttgtcattgcacaacaaagcgcttctacatcgatgctgcaacgacgctttcgaattggctataatcgtgcggcacgattgattgacgatcttgaagctaatcagattgttggccccagcgaaggcagtaagccccggaaagttttcgtcaccccaacagatgggaatcagtcatgagggagactatgcaaaaagaaatcaagccgggcgtttggcttatggttttgccaaccacccaatttaaaaccactcggatcaatattcagtttttaaccccattgcggcgagatacggtcacaaaacgaacgttgctgaccagtcttttggagacaaatagtcaggagtatccaactcaagcagctatggcggcccatttagagtcactttacggtgcaaacttcagtattggtgttgcgcgcgaaggccgactgcaccgggttggggtgacaatgagtactgtggacgatcggtttacggatgcaccgttgttaccaaaggcagcagcgtttttgaagacggttttgttttctcccaactttcaagctgggcaatttgacgcggcaacttttgatcgggaaaagcaaaacttggatcactatctggccagcttagatgatgatcgccaaacgcaggcagcattgggcgtccagcgtctgtatttcggcgttgatcctgatcaggctatccccagctttggcacgcgtgaagatcttgccccgatcacgacagcgagtttaaccgcctattaccatcaaatgatcagtgaggatcaagtcgtcatcaccgttttgggcgatgtccaggctgaaaacgtggcggctttgtttgctgattggccactggcggcgcgctcgcaaaccacccctgcgattgcatttaatttaccggagcatgctgaagtcgtcagccaaaccgccaaagtcgttgcccaacaagctaaatttgatcttgcctatcatgtcagtacggatttgatgggtccaaagtatgcagctactttagtggcagaagaattgtttggcggttcaagtttgtcattgctcttcaccaacgttcgcgaaaaggccagtctggcttactacgcgagttccatgttggatacttttcgcggcttgatgttggttcaaaccgggattgaaagcaaagatcaggcgcgggttgcggatttgattcagcagcaactggcagccattgtgcgcggcgatttttccgatgaccggttgcaggcgattaaagatggcattttggatcatcagcgtgcagcgtatgatagtccgcggtttttgacaaatcaggcgctgtatcgactgttggtgccggacgcaccgcaagactttgaaagctttgctagccgaattcaggcggtggatcggcaggcagtgcaacaagcggcggccgcgatgaaactgcaagcgacgtattttctgactggggaggacagcgaatgaagacacaatatttccgtgatgttgatgaaacactcatcacaacgacgctgcccaacggtttgcgcctgcaagtggtgccgcgcccggcttatcataaaagttatgcgatcatgaccactgattatggtgcgattgatacgcgctttgctccggacggcaaacagatggtgacttatccagccggcatcgcccattttttggaacataagttatttgaaaaagaagatcatgatgcatttgatcttttcggcgagaccggtgcgtcagccaatgcgtttaccagtgcgacaaaaaccagcttcttattttccacgaccactcaattcaataagaacctgcaaattttgcttgattttgtgcaggcaccgtttttttccacggaatcggtggctaaagagcaaggcattatcggctcggaaattcaaatgtatcaagatgatccaggttggcgggtgtatgctggtttgttggaaaaccttttccccaatcatccagcgcatgttgacgtggcaggaacagcagcaagtatcgctcagattacgccggagatgctttataccattcaccgcgttttttatcaaccaagcaatatgactttggtgattgttggcaatattgatgtggagaatgtgattgattttgttgctgccaatcaggctcaaaagacatttccaacgcgacagccaattgtgcgaggcgttgaagcagacgtgcaaacagcagatattattccttatcgggagttgaaaatgccggtcagtcgtcccaaaacgctggttggctttaaaggacaggtggcaattccgcagacggctgctggttggcagtatcaattaagtattcgcctattgctggaagttttgtttggggattcatcgcagctttatcaagcatggtatgaccgcggtttgattgatgactcgtttgattttgattttacgaatcagcgtagttttagttatgggcttgttggcggcgacaccgatgatcctcaaggcttaagcgccgccatcaaggaagtattggcacatgctgcggatcaggctgatttgaatagaaatcgggttgcgctaattaaacgcgcgtcactcggcaaatactatgccggattgaatgggttaaatggcgttgccaaccaactaagcgccttaagctttggcgaagcgtctttgtttgattttccgcaaatattaaacaggattagttttgaagatcttgagcagttaattcctaaactttttaatactgaagctttaacggttttgacaatgcttccggaggggaaataatgcgatcggcgttaatcattggcgcttctggtgatattggccaagcggtagcagcaaaattggcggcagcagggtggtcgctttatctgcattactttaagcatgagcaagttgtgatggatcaaatgaaggcttatcaagcagcatatccgcatcaggactttattccgttacaatatgatttgacggatgaccgtcatctagacgaactcacaaatcaactttttagtcttgatgctgtcatttttgcagctggcatgacctattatcatctttttaaagaaaccaccgtccctgagatgacgactttaatgcgtgtccatttgttaacgccgatggttcttttgactaaagtggagcgtaaattggcacaatctggtcatggacgcgttattttcattggatctgtctatggtggtaccggatcagcgatggaggtggcctatagcacggtcaagggagcgcaaagtgcctttgtgaaggcttatgcacaagaagttgccagtcttggcattaccgtgaacgttgttgcccccggagccgtcaccaccaaaatgaatacaaaaatgtttgactccgatacactcgccaaagttcaggcagagattcccgcggctcggtttgcgaccccccaggatattagttactatgtcagtatgctggttgccaaggatgcggcttatctaaccggacagacactgtacgtaacaggcggctggcgcatgtagtaaacaaaggatttcttaaggctttcagacggtttttcatgctatactgaaaatggttaataaaaaatagcgggtgaagaaaacatatggatgaaattgggcaaaaattacgggacgcccggattgaaaaaggctataccattgatgatctacaacaaattaccaaaattcaaaaacgctacctgattgcaatcgaagaaggtcatttcgatgcgttgccaggcgacttttatgtgcgtgcctttatcaagcagtatgccgatacggttgggcttgacggggatgaattgttgacgcaatttcagcaggatatcccggaaccgcaaccccaagaatacgctgcacagtcagttgaaaataagactcgggcgacccgcgccgaagaagcgagtccggttaaccgtttgcggcgttatctgccacagattgcgattgctgcctttgtgattgttgccatcatcgtcatttatgtcgtgatgctattttcacaatccggaccgaaacaaacgattcccgcggattccgagagtgttgcggtttcgtccaagcgcagtagttctaaggcatcgaaatcatcaaaaacctcatcatcctcgaagtctagcaagtcttctgcatcaagtagttccaagtcatcagaaaaggcatctaaagaaagcaaaaagaagagtgacaagctcgacatttctgttgctgcggcaaatggtgctactcaggcagttacgttgaagaatttgcctaccagcgggaataaacttaccctcggtgcaaacggggcgaccgcttggatttcagtcattgtcaatggttcgacaacttggcagggttccttgacatcaggaaatacacaagaggtgacattgccagataatacgtccaccttccaagtccgctcagggaatgcgactgctacgacgattgagttgaatggcaagaaggttgacatttcgaacggtaccagtgttgttcgaacgattaccttcacaagcagtacgagtgaaagtgaggcttctcaagaatgaatctccctaataagttgacgctgattcgcattttcttaattcccgttttcactttgttattggcattcaattggccggctggttatctgacaattgccgggacaaaagttgccatgagctggtttatcgccttgattatcttcattgtggcctcacttaccgattttgcggatggtcagattgcccggcgcaaacatttagtgaccaattttgggaaatttgccgatccgttggccgataagttgttagttatgaccgcatttttgttcctgacagcagctggacagattccagcatggggaacggcgattatcctatggcgtgagttagcggtgacgggtttgcgactattgctttccaatgaaggagaggtactggctgctgcttggcccggaaagattaagaccaatacgcaaatgtttgcgatcatctttttgatgctcaataacgcatggttcaacaacattaacattccgtttgcgctaatccttttctatgttgcagtgttcttcacgatttattccggcgtggaatatttttacaagaatcgcggcgtttttgcagattcatttggatctaaacagtagtaatatcgtttttttacccaggctgatggcttgggtttttttgtgcccgtcattcggcgcaaaacggaacgggtagtaaaataaaactgaagcttgttgggtttggaggcattgtttatgttaatggttgggtgatcgcagcagaatttttgaatattgagtgaatgcattaaagggcagatgtgctaaacatcgaattctattgttaggtgggaaaaatatgcaagcagaaattattgctatcggaacggaaattctgatgggacaaattacaaatacaaatggcgcgtatatggctaaacaactggctacattaggtattgcgagctatcatcaacaggttgttggggataatgcaaaacgactggctgacgcgataagtttggcggaacaacgcagtgatatcgttattttgattggtggtttaggaccaacaccggatgatttaacgaagcaaaccctagccgcacacctgaatttacccttggtggaagacgctgacgctatggccaagttggctgcgcgggttaaacaacagcaacgtccaatgacacccaataatcgcctgcaagcgatgtatccccaaggcgcaatcgtattggccaatcgtgtcgggttggcggtcggcgcatgggttgagcagcgccaacacgcctatgttttattgccgggaccacctaaagagtttgtgccgatggttgatcatgaactgttgccacgactggcaaaatatagcgggcatcaagaagttttggaaagtcgcgtgatgcgtttctttggtatcggcgaatcgcaacttgtgacagacttaagtgatttaattgccaaccagacgaatccgacacttgcaacttatataaaagatcatgaggtgacagttcgggtaactgcgagtggcaaaacacaagcagaagccgcggcgaaacttgagccaatgatcggcatcattatggatcgtgaaggtcgctacttttacggctacggtgacgataacagtcttgcccaggaattagtcaaagcattggcggctagtgataagcaaattagtgccgctgaaagtctgactgcaggtgcatttcaagcggcattgggagacgttccgggagtctcggcttatttcaaaggcggcttcgttacgtacgctttagcgacaaaagctgcatttttaaatattgatgcccgtcagctatcagaacatggtgtggtgagtgaatttactgccaaagcaatggcagagcatgctcgtcaacgagcggcggcagacattgccgttagttttaccggagttgccggtcctgacaagctggaaggacagccagccggcaccgtctggattggtttggcgcggttaggagagaaaccaatagcacaagtttatcattttccgggtgggcgaaatgacgtccgcaagcgcgccgttatgacggggatgatgatggtgttgaagcgtttacgcgaataacagcaaatagttgtggatggaacaagctcattaaacaggaggcggtaagagatggcagaaaccgaacgacaggaagcattggcaacggcgttaaagaagattgagaagaattttggcaaaggggccattatgcggatgggggacaaagtggagacacgcgtttctgctgtttccagcggatcacttgcaattgatgatgcacttggtgttggtgggctgccacgtggacgaattgttgaaatctatggtccggaaagttccgggaaaacgactgtggccttgcatgcagttgccatggttcagcaacacggtggcacggccgcttatattgatgctgaaaatgccatggatcccaaatatgcggcggcacttggcgtcaatattgatgagctgttgctttcacagccggataccggtgaacaaggattagaaattgccgatgagctggttgcatcgggcgccattgatattttagtggttgattcagtggcagctctggtaccgcgcgcagaaattgaaggggacatgggtgatgcacacgttgggttacaggcacggctaatgtcacaggccttacgaaagttgtctggggcgatcaataagaccaaaacaattgccttgttcattaaccagatccgggaaaaagtcggcattgtattcggcaatcctgaaattacgccaggtggtcgggcgctgaaattttatgctactgtgcgtatggaagtgcgccgttccgagcagatcaaaaacggtgccgatattattggcaatcgcaccaaaatcaaagtggttaaaaataaagttgcaccgccgtttaagactgccattgttgatattatgtatggtcaaggcatttcccaaagcggtgaacttgtcgacatggcggttgaaaaagacatcattgaaaaggcgggttcatggtatgcctaccaaggcgagcgcattggtcaaggacgtgagcacgctaaaagctatcttgaaacgcatgaggagctgcgccgaaccattgaaaaacaagtccggcttgcttatggaatgtcgccggatcacgttatcgatcaagcagacatagagacagatactaccacatctgccgcatcatgactggttaaaaggggtgcttgttgtgttgcgagcggatcgggtgtgaaaatggctcacgcttttcataacgcgttcgtagtcgcggcaatcggagtgtaaggaccttgattgcaatggtcaaaatcgggccatcacgtatgaggccacttatgttctggcttacgtccataacgcgctcgccagcccagaaacctgcacataaggaccttggtcgcaatgaccaaagcccggtcatcacgcctgaggccacttatgttctgttttacgcccataacgcgttcgccagcccagaaacctgcacataaggaccttggtcgcaatgaccaaagcccggtcatcacgcctgaggccacttatgttctgttttacgcccataacgcgctcgccagcccagaaacctgcacataaggaccttggtcgcaatgaccaaagcccggtcattacgcccaaggccacttatgctccggtttctaaccgggctggctcgcgctcactaaatttgcctccagttgacaccttgcaggccagcacgtaaactaatagaggtgtaataatttaaaaaaagcatcaaagattttgatcaacttgatgattgaatcgcttagatgatgcggaggtgaaatgatgagttcagtaacactggtctcaataaccctcgcagcagtcatcgctttagcggtcggtttattgatcggatttgcacttcaaaagaagctccaccagaacagtttggatcgagcgacgcagacagcagaaggtatcattgaggccgctaaaaaagaagcagcgactttaaaaaaagagaaactgctagaagcaaaagatgagaatcatcgctatcgaacccaacttgaagacgaattgaaagatcggcgggcggaagtccagaagtcagaacatcgactgaaccagcgagaagatactcttgatcggcgtgatgacacgcttgatcgtaaagagcagagtcttgctgaccgggaagcaaatttgaacaagcggcagcaacagttagatgaacgtgaacaagctatctcttctgaaatcagcaaacaacagacagaactcgaacgaattgccgagctaagccatgagcaggctcggactcagatccttgaccagacacaatcagaattgacgcatgaacgcgccgtgatgattaaagaaagcgaagatgaagcaaaggaggccgcagataagaaagccaaggtactgattgcggatgcaattcagcgcagtgcttcagatatcgttgccgagacaacggttacggttgttaatttaccaaatgacgacatgaaaggccgaattatcggtcgtgaaggtcgaaatatccggacacttgagactttgacggggattgacttaattattgacgataccccgcaagccgttgttttgagcggatttgatccgattcgacgggaaatcgcgcgaatcgcgttggagaagctcattcaagatggccgaattcatccggcccgcattgaagaaatggttgataaggcacgcaaagagatggatgaccgcattcgtgaaatcggcgaacaagctatttttgatgtgggtatccataatatgcaccctgacttgattaagattttgggtcgcttgcattttcgtacgagttacggtcagaatgttctggatcattcgattcaggttgcaaagctggccggtgtgatggctgctgaattaggagaagatgttaccttagcaaaacgcgcggggttattacatgatattggtaaggcgctcgatcatgaagtcgatggatcccacgttgaaattggggtcgagctagcaacaaagtacaaagaaccaaagacggtgattaatgccattgcgtcccatcatggtgacgttgaaccaactagtgtcatttcggtactagtcgccgccgctgatgctatttccgccgctcgtccaggcgcgcggtcggaatcacttgaaaattacctgcatcgcttagagaaattggaggctattgccaacagtcatgctggcgttgaccatagtttcgcgatccaggccggtcgtgaagtacgggtgatcgttcagccagaaaaactttctgatgatcagagtgtcattttggctcgcgacattcgcaatgaaattgaaaaagaattagagtatccgggtcacatcaaggttacagtcattcgagaaacccggaccgttgaatatgctaaataagtttgcagttaggccttattaaagggcactatatgtaaaccaaaaagatccgcaagcggtaattgagcttgcggatctttttacgtttttaaggcttgtgaacttctgacgtggcataagggacctcacgatactgacttgtaccgatctgtgggtcaaattgtccgtgtaggaaatccttgattaaggcgaggttcttgtctaactggtcagcatcaagatgtagcgtcagtgtcactgctacgccataatcaatggttgcgattgtgaggttgtgcgtttctaaaaaatgctgcagtggatcaagatccgcatatggaatctgaaaagtaacagccttttgtttaattcgggctacaatgccaattgtttcaattgcggcgttgacattgccggcataagcgcgaatcagaccgccggcaccaagcttgatcccgccaaaataacgcgtcgtcacggcgagtgtatcgcgaagttcatgttgcaagaggccttcaagcgtcggggggcctgcagttccggatggttcgccgttatcgctggcccgctggatttggttttcgttaccgagcacgtaagcaaagacattgtgatttgctttggcatgctcgtggctgatgcgatcaataatagcctttgcctcgtcttcatcatgaatacgagcgaggtgggtgatgaaacgagactttttaatgatttgagtgtaatttccggattcttttatggtgagatatggcttcattatgcgtaatctccttttgaggtgatgaaaatggatctggcaggtgcccaactcacacagcgtgaactggcgcgtttagctgtttctaatatatcacacgcaactgttgtgccggcattggtaaaagaccatcatcagtggcaatgtcagcgatgttgcagccgcagacctgttgcactgccagatggccgaatctactgttcggagtgtgttgctttaggacgactgaccaatgccgatcatctttatcggtttgaacaggcgcatctgccggttggtgatggtcaattaacctggcatggtgtactaacacctgatcaacaggcggcatcggatgcattacaggcgagtgtcgcagcagggcgtgagcatttgatttgggcggttaccggagcgggaaagactgaaatgctttttccgactattgcccagctgatccagcagcaaaagcgggtggccattgtttcaccacgaattgacgtgattcgggaactggcaccacgatttcgaacggcatttgcaaccacacccatttccgtgcgttatggtgggcattttgatcaaacggatagtgatttgcttttagcaacggttcatcaattattacgcttttatcgggcatttgacttaattgtcgtagatgaagttgacgcgtttcctatgcgcggaacaccgatgttgcatcaagcagtgagacaggcacgccgcggctcaattgcttatttgacggccactcctgatcgtcaattaaaacaggcaattcggcgggggcggcttggggttagtcgactttttcgccgttttcacgggcatccattaccggttcctcggattcaattagtgaacttacggcatgtgccccatcagcttcccaaagcagtcattgtgtgggtgcagcaagtgctagcgactaaaagagtctgtctgttgtttgtgccgaagattagttgggcagaacaacttgccggtaagttgcgccaaatagggctaaaggcggctggtgttgcgagtactgatgcgcagcgggcggaaaaggttacagcatttcgacaaggacaattggaggttttagtgacgacaacaattctggaaagaggcgtgactgtccctcgctgtgcggttgcagtgctagcagcggcagatcccgagttttcggcatcagctttaattcaaattgccggtcgagctggtcgggcagcggatagtccggacgatccggttgtcttcttttccgatcgttatacccttgcgatgttggcagccagacgccaaattgtgatgatgaatggcaggtgaagacgatgcgctgtattggttgtacccgcccgacagatcgcggcttgaagctgacaacgttattttcccgtggtccattgctagcgccgaggttatgtcacagttgcttgagccaatttagtttcattaccggtataacctgctccggctgcgggcgaatgcaggtagccgcggagccatgtttggactgtcgaaaatgggcgaagcatgggccgcttttaaataatcgggccttatttgtgtatgacgcgaaaatgaaggcgtggatttaccaatataaaggactgggtgactatcggctgcatgtagcttttcaggatttgattgccgagcgtctgcgacatgcagaagcgttggttcccattccaagcgaagctaaacattatgaatggcgcgggtttgatccgattttaggattatttggttgcctgccattacaaaactggctccaaaagtcggcaacagcgcgaccacaagctcaaaagacccgccgagaacggctgaagacgccacaaagttttcgggtgctcgtttcagccaaaaccttaaaccgcgtgcgtcagataacattgcttgatgatttgtatacgacggggcggacgttgtaccacgcgcgggatgctttagtggctgccggtttcaaggggactatccaggcgtttacattaattcggtgaaatgtggcttttgttgtgtctggtggtaacattcgggtataatgaagttggagattggaagggttttacccttagctatggctacgttagccgcacggagcggtataatgaagttggagattggaagggttttaccccagccaatcagcgtgtaagcgttttgcctacacgcaggaaaggggagaagttttatgctcacatacaatgttcgtggcgaaaacatcgaagtcaccgaagccatcagaaattacgtggagaagcggattagcaaactgaacaagttctttggtggttcagttactgcgacagcgcacgtcaatttgaaggtttacccagataagaccgcaaaagtagaagtgacgatcccgctgtcgttcttgaccctgcgtgcggaagaaaccagtccggatctgtacgccagcatcgatcttgttactgacaagctggagcggcaggtgcgtaagttcaaaaccaagattaatcgcaagtcacgtgaaaaaggctttggtcagattgacatcgatagcaatgcaccggctgaaccgaaaccggccgaagatgatgataatctgaaggttgtgcgaacaaaacgcgtttcgttaaaaccaatggattcacaggaagccattttacagatggatatgctgggccacaacttctttatcttcgaagatgcagatacaaatggcacgagcattgtttacaaacgtcgtgatggccgttatggcttgattgaaacgaacgaataatagcgattttcttaaaagaaaggcaaggctgctgcttatcagcgggcttgctttttatttgcctgtcagctccatcatgcctataaaacgatgcgtgtggctattacagtttatgagaagtgtggcaattaatgtgatttttgacgcggagatctgtatttaaggatcttggtcgcaatggccaagagcgggccatcacgtctgaggctacttatgttctggcttacgctcataacgcgctccccggcgcagaattctgcgtgtaaggacctcagacgcaatggccaaagtgtggttatcacgttcaaggacgctaatgttctggtttatgcccataacgcgttcgccagcccagaaacctgcacataaggaccttgggcgcaatgaccaaacccgggtcatcacgcccaaggccacttatgctccggtttctaaccgggctggctcacgctcaccaagttattttcaatctcccctttaaaatgttaagatgttagaatgtataaatgttaagatgtataaatgttagaatgattaaagtagtgttagttctacgaggtttcgacagagaggaatccattaatggccaatattcttagaaaatgggtcgaaagcgataagcgagaaatcggtcgcctcggcaaaatcgctgatcaagttcagcgctatgaagatgaatatgcagcattatcagatgatcaattaaaagcaaacacccaaaaattcaaggatcgccttgcagcaggggcaacgttagacgatattttaccggaagcttttgccaccgcgcgtgaaggggctaaacgagttttggggttattcccgtttcgggttcaaattatcggcgggatcgttttacatgaaggcaatattgcggaaatgaaaaccggtgaaggtaaaactttgacggcaaccatgcccgtttatttgaatgccttgactggtaaaggggtccacgtggttaccgttaacgagtacttgtccacgcgtgatgcaacggaaatgggcgagttgtacaactggctcggtctcagcgtcgggttgaatcttaactccaagaacagtgacgaaaaacgcgaagcctataactgcgatatcacctattccaccaatagtgaactcggttttgactatttgcgagacaacatggtggtttataaggaacagatggtacaacggccactgaattttgcaattgttgatgaggttgattcgattctcattgatgaggcccggacacctttgattatttccggtggcgcagaaaagacaaccggcctttatattcgggcggaccgcttcgttaagacgcttaaagccgatactgattacaagattgactggccaacgaagaccatttcgctcactgaaagcggcattcgcaaagccgaaaagaattttggcttggataacctatacgataccgaaaatacggctttaacccaccatatcgaccaagcattgcgggcaaattacattatgcttaaagatatcgactatatggtgtctaacggcgaagtgctgattgtcgatcaatttaccggtcgggcaatggaaggccggcgctattccgatggcctgcatcaggcaattgaagccaaagaaggggtccaaatccaggatgaaaataagacgatggctaacatcacttatcaaaacttcttccggatgtacaccaagctggcagggatgaccggaaccgctaaaacggagcaagaagagttccgcgaaatctataatatggaagttatttcggttccaaccaataaaccggttatccgggttgattcaccggatgttttgtacccgactttggatgctaaattcaatgcggttgttgacgatatcaaaaaacgtcataaaaaagggcagccgattctggttgggacggttgcgattgagtctagcgaacgtttgagtaagcaattagacgatgaaaaaatcccgcacacggttttgaatgcgaagaaccactttaaagaagcggaaatcatcatgaatgccgggcaacgaggcgctgtgacaattgcgaccaacatggctggtcgtgggacggatattaaattaggccctggtgtcaccgagttaggcggtttggctgttattgggaccgaacggcatgagagtcgccgaattgataatcaattacgtggccgttctggtcgtcaaggtgatccgggttctacccaattttacctgagtctagaagatgacttgatgaaacggtttggctctgagcggatcaaagcaatgctggatcggttcaaggttgccgatgacgatcaggtcattcaaagtcggatgatctcacggcaggttgaatcagcgcagaagcgtgtcgaagggaataactacgacacgcgtaaaaacacgttgcagtacgatgatgtgatgcgtgaacagcgtgaagttatctataagcagcgccagcagattatcaatgaagacgagaccctgaagcccgttttgatggcgatgattaatcgaaccatcacccgcatcgttcaaacgcatacccaaggcgatcaaaaggattggaatcttgatgcgttgtatgcctggatcaccgcaaacatggccgatccggagaaattcaagcgcagcgaacttgatggcaagtcgcaagatgagctcatcggtttactggcggatatggctgaaactaacttccagcataaaaacaagcaacttggcgatgacgcgcagatgctagaattcgaaaaagtggtcatcttacgcgttgttgactcagcttggacggatcacattgacgccatggatcaactacgccagtctattggtttgcgtggttatgggcagatgaatccgctagtcgaatatcaagaagaaggctaccggatgtttgaggaaatgattgcgtcaattgatgatgatgtgacccgattgttcatgaaagccgaaattcggcaaaatattcgccgttaatggtgaaccggcgccccggcactgcaagctcaaatttgcggtactggggtgttttgaggataacagaagcagaagctaaatgtaggattgaggcaacccggtctttactaaaatcaacttaaaaaaagaggagcaattatcatggaactcagtgtcatgcgtaacaccttggccgccatgcgaaccaaaataaatcaattcagggggtctctttgacctcgatgcgctgaatgaacgcattagtgaaaatgaaggtagaatggcggaaccgggcttttgggatgattcggaagcagcacaaaaagtgatcgatgccaacaataaactcaaagaaaaacacgatcgcttttacgcacttgaaaatgaactggaagatcttgaggctggattggagttgttacaagacgaacccgacccggatttgcaacgcgaagaagagaccaagcttaaagatctgcaggaaaaacttgatcagtatgagatgcaattgcttttaaatgggccatatgaccacaacaatgcaattctcgaaattcatcccggtgcaggtggtacggaatcacaagactggggttcgatgttgatgcggatgtatcagcgctgggccgaccagaatggtttcaaggttgaagtcgcggattaccaacccggtgacgaagcaggcattaaaagtgtgacgcttttgatcaacggtgagaacgcatatggcttattgaaaagtgaaaaaggcgtccatcgcctcgtccgcatttcaccatttgattccgccggccgccgtcataccagttttgcctcggttgatgtgatgccggagcttgataattcgattgaagtcgatattcgcccagaggatatcaaaatggaagtgtttcggtccagtggtgctggtggtcagcatattaacaagacttccagtgcggttcggctgattcatctgccgaccgggattgtcacttccagtcaggcacaacggtcacaatttcagaacaaggccacggcaatggcgatgttgaaagccaagttatatcagcgtgaagaggaagccaaaaaggccaaagccaaagccattcaaggcgagcaaaaagatgttgcttttggctcacagattcggtcttacgttttccacccgtacacgatggtcaaggatcaccgaacgaattacgaaaccggtaatgggcaggcagtgatggatggcgatcttaatccatttatcaatgcatacttgcaatgggagctcgcccagaaaaatcctgattaaactgtaatctgcctgaaatcttgctgacttaatcggctgttatactaatcctagcttagaaaaaggagcaaaatgcatgattcaaatggaaaacgtgacgaaacagtatgctaacggcgtcactgccattaaggatttgaatcttaaaatccaggatggtgagtttgtttacgtcatcggtcctagtggtgccgggaaatcaacgttcgttaaaatgctgtaccatgaattaaagccgtccagcggtagtattaaaattgatgattttgatttttcaaccatgaagccgtcgcaggtgccgtttttgcgtcgtcacatcgggatcgtctttcaggacttcaagcttttaccacgcttgacggtgtacgagaatgtggcttatgcgatgcaagtcattgaagcgccggacgataaaattaaagaccgcgtgctcgaagtattaggactcgttggcttggaacagaaattgcggcgttttcctgatgaattatccggtggtgaacagcagcgggtgtcagtagcgcgtgcaattgtcaacaagcctaaagtgttgattgctgacgaaccgactgggaaccttgatccgcaaacctccgatgaaattgttgatattcttgaacgtatcaatgcaaatggaacaacggttatcatggcaacccataacaaggatattgtgaatgaacgtcaacaccggctactcgaaattgccgggggtcgcttagtgcgtgacgaagaaggaggcacatacggcaatgaagagtaaggtctttttccgccatgttaaagattccctgcgcagtttgcggcgtaacggctggatgtcggttgcagcggttagtgcagtcaccgtcacattactgttggtcggtatttttatggccttgattttcaacctgcaccacatttcacaacaagttgaaaatgatgttcaggtgcgggtttatattgataaaaaaacaaccaccaaacaacgtgatgaccttaaagacaaacttaaaaagctggatcacgtcaacaaggtcacttaccgctcacgtcaacaagaattagatacaatcatcgggggttatggttcgcagtggcggatgttctccggggatcaaaacccattaagcgacgtgttcatggttaagacgaatagtcctaaggccaccatcagcgtgtcaaaagaagcacagaaactggatcatgtggttgatgcaagctatggcgggcgaacggcaaagaaactctttaattctgtggatgtagcccagaaatggggacttgctttcacgattctgcttctgtttgttgccgtgttcctgattaataacacgattcgaattaccattttgtcacgttccgacgaaattcggattatgcgattggtgggggcaaccaattcttacattcggtggcctttcttgcttgaaggtgcctggaccggtttgtttggggcggtattaccgattattattgtggatgtcggttatgcgattgtctatcggagcttcacttatgcaaacggagccagtggttatacgctttatgccaatatgccgttcttgttctggcttgacttgatgttagccgggatcggcattgtcatcggggcgctgggatcagttatctccatgcggcgttttcttaagttttaatttcaaaattgaacatttgagttgctgctatcgactcaatgtgaaaggattgctcttttccgggcagtccttttttggtgggtggttttaatgaatggcagtacgatgttttgaatacgcaagcttatgtcgaaaataactcatacatgttaattgatgggacaaaaatggccgtttttcggcattttctggttgatgagcccaaaaccttgtaggaagcggtcgttaatttctgctatactggtcacagtgaatattggagggttaccgatggcagtgatcattgccttacttatcagcccgattggtgccgtattctggcttgctttagggttgacgattttgtatgcggttagccggacaagccgcgaacgccatcagtacttgcgggcgattcatccccaacatagcgaaattgccccattcttttgggtcggtattttgctaggcatcgttatctcggcactgatgttggttgcgcgcttacaagttagtttgcccgcattattagcattaagtggctcaacgctggtcgggctaatcttttctggctggcggttcagtccatggtggctaggattagcgggcttagttgaattgctgcggccgacaacgagccaaatgagtgctgatttagccgttttagttggtgtgctgtggttagcacaagctttgatcgcgcggttaaatcggggcgctcaaattgagtccccggttattttgcaggatcgacgtcaacgtcaacaggttgcgtttcgattgcgacagttttactgggtgcctttgttcttaccggtgagtgttgatcaagttgcgggattgccgctcttatcaatcgcaacggatacttttgttgcggttggacttccactggtcttaggcgcggcatttaccacgcagcgtgatcgtgttcaaccgtatttgcgccgaagttggccatggtttgcagttgccggtggcggtttgatcgtctttggactggtgggtcggatccttaccatgcctgcgatgacaattgccttagtacctgtgttggtgagtttgatactcggtgccggcttagtttggcaagcacatcaagtacatttaaacgtgacacaaaccaatcacggggtggttgtcatcggggttgtcccacagacaccagccgcacaaatggatttgcagccgggtgatcgggtcttgacctgcaatcatattgccgtcaacaatgccgctgaactttataacgcaattcaaaaggaacccacttattgccgcttacggcttcaacaggcagatggcgagatacggctagccgaaaccgcaatttttgccggtgcaccccatgaacttggtatgattttattcccggaggagacagcatgaagaagatcttgattgttgatgatgaaccagccatcttaaccttgctgcaatacaatttagaggctgaacactatcaggttgaaacggcaacggatggtcaggaggctttagacaaagtacgtagcgagccgtttgactttattattctcgatctcatgttgccgagtttgagtggactggatgtcacccgtaagattcgtgaagaaaagattcaaacgccaatcatgattctgacggccaaagacaacgaaaccgataagatcgtcggacttgaacttggtgcggatgattatgtgaccaaaccgttttcgccgcgggaaattattgcccgaattaaagccatcgaacggcgtagtcaaagtcaaccacaagcgccacttcctggtaatgccaatcaaattacggtcggtcaaattacgattgatcctgaaaattataaagctagcaaagccggacaccgactccaattgacccctaaggaatttgaactattggtttattttgctcaacgagttggcaaaacgctatcacgcgatgctttgctcaatggggtttggggcttcgattacccggcggaaacacggatggtcgatattcaggtcagtcatttgcgggataaaatcgaaacagatcctaaacatccggattacttaaagacggtgcggggattcggttatcaaatggaggcgccacatgaataaacggattttacgccgtgtactggttattagtctgctctcgttagcaggcttttttgtactcgtcacgacggtcaatcaacaaatcgtacatcagcaggcacgcgatttgaggcgcgtagccagaacctatgcagcctctgctaaggatggcgttgatccgcaagcgctggcaaagtccgaagccgcttttattacggttgttccggataatcccaaaaccacccgacaaaaagtgatggccgatgccttacgtggcaatcatcgcgaaccatttgtgacaacggttaatgttcttgggcgagctgaacaggcatatctgtttcgtcaccggggacactgggttgccgttagtcgctataagtccagcgtttggacaacggcgcctgagcaattttggattttgacgctgacatttgcggtcctgattgctttaattctggcttggctttttcgctcggagcatcagtatcaagaagccattcgggtcatgagccacaacttggatcggattcgccagaaaaaagagcccgagcctgtgattctgccgccacagtcgccgtttacgcctgtggcacggcgaattaatgccttagctgcggaacaaacccatttacgtgagaaagtcgcagtacggcagtccagttttgatcgtctgattgataatttgccactaggcgtcatgttgattgataccaataaggatgtcattttgcataatcatgccatgtcccagcttttgggccatcagattccgcagccgcggcacaattatctggacgatgttaagacttatgcgttggcccggatgattgagcacacttttcgccatgaaaagactcatcatcaggagttgaccgtcctggcaacccaaaagtcggttgatgccagtgtcattcctttaaaccaaggaactagtcgtctccaggtgttggttattttgtacgatgtcacgtatttgcgccaagtcgagaaaatgcagctcgattttgttggcaatgtgagtcatgagctaaagacgccggtgactgctatttccgggtttgccgagacactattaagcggggctaaaaatgatccggcgacgctagataagtttttgaagattattttcgatgaaagtaagcgactgacccagctcatcaatgatattctaacgttgagccggcccgaatcgaatcaaacggtgcaggcacaagtaccacttaagaagttagtcgacgatgcattgcgtaatttagctaaagtgattaaagacaagcagattcgggtggaggtggcaattgcaccagacttacaggttgtgaccgatgagcgcaagttaactcagattgtgcggaatcttttgaacaatgccgtgttttataatcgattagccggacatgtgacgatcacggcccaagtagtcgaagggcacttgtcattggcggtcgctgataccggtattgggattcccgagacagagcaggcacggatttttgaacgcttctatcgggttgataaagcgcgcagtcgtcacaatggcggtactggtttgggtcttgcaatcgttagtgagctggtgaaaagtatggatggtcaggttgccgtttcgagtcaagtcggggttggatcgacctttaccgtgacattgccggtcagcaagcgccagcagcaagattgatgagatatttacagaacctttacattcaacgacatgaacatttacacgcaactgttaagatgattggagcttgaaatggaggatttcgtgtgaaaaaaattgtgaccctgttttcgatcgtatttttggcgctgttagcaagtgcatgtggcagcagtcatagttcgaaacagtcgggtgaatcaatcaccgcagttggatcaagtgccttgcagcctttggttgaagcggcgggcgaacaatatcagacggaacatctcggcgtgtttatcaacgtccaaggtggcgggagcggtaccggattaagccagatccagcaaggggcggttgatatcggtaattcggatctttttgctgaagaaaaaccgggcattaaagccaacgccttggtggaccataaagtggctgttgtcgggattgcgccgattgttaatcccaaagtcggtgtgaaaaatgtgtcgatgacgcagttgcaacagatctttctgggtcagatcaccaactggaaacagttaggtggcaagaatgtgccgattgtccttgtcaaccgcgcacaaggttcggggacccgcgcgacttttgaaaaatgggcgcttgaaggcaagcaaccgattgccgctcaggaacaggattccaccgggatggtgcgacaaatcgttggcagtacgccaggggcaatttcttacgttgccttttcttacgttgataaaaccgtccgcagcttgtctgtagacggcgttgcaccaactgatagtaacgtggcaacgaatcgctggcatatctggtcgtacgaacatatgtatacaaaaggtcggccaagtggtttgaccaaacgatttttgacttacatgatgtcaccggccattcagaagaaactggtccaaaaaatgggctacattccgatgactaaaatgaaagtggtgcgtaatgccagtggccagattagtcgtccgtaaacgagtccagcgtctaaaagctttttcggcttacgaattgatgaagcaagtcagtgtgggcagttaggttcaggcaacctagcagatcaatgaaggcagatgcggccaggacgatggctagttgcggtgaggttttaggaggttatgatggatccaattcgagaagcgatgctaaaaaaatcgcgctcatcaaagttagagcgacgcggcaaaacgatcagtctgatttgtatcagtctgattgtacttgtagtggtggcaatatttttctttgtcgcctcaaaaggattagcaacattctttcaaaataagattaatttatggtcgtttttgagtaagagtgtgtggaacccatcaattaaagatgcccatggaaatccggaagttggcgctttaccgatgattgtcgggtctttcggcgtgacttttttatcggcaatcgttgcaacgccatttgcagttggcgcaggcattttcatgaccgagatttcccacaagtgggggcaaaaagtgctacagccggttattgagctgctcgtcgggattccatctgtggtttatggcttcatcggcttgtccgtcattgtacctttcattcgccatatctttggcggtactggctttgggatcttagccgggacttttgttttgtttgtcatgatcctgccgactgtaacatccatgaccgtcgatgcgttaaaagctgtcccgcgccattatcgcgaggcttcgttggcgctaggtgctactcggtggcagacgacttatcgcgtggtgctgcgtgcggcaattcccggcattttgaccggtattgtttttgggatggcgcgcgcttttggtgaagcgttggcggttcaaatggtcattgggaatgcggctttgttgccaaagaaccttgtttcgccagcttcgacgttgacttctgttttgacgagcgggattggtaatacagtcatgggttcgctggaaaataacgctttatggtctttggcattgctgctgttgctgatgtcattagcctttaacctgttgattcgttggatcgggaagaaaggggagctgaacaaatgaatccaaaagttgttgataaaattgccacaacggttctgtacattgtttcagggattatcattgttattttggccagtctcctcgggtacattctttttaaaggggtaccgcatatttcctggcattttctcacgagtccagcacaaagctttgaagctggaggcggcattggtattcaattgttcaattcgttttatcttttagtccttgcgatgctgatttcaacaccgatttcgttaggggcaggcatttacctcagcgagtatgccaaaaagaattggttgacggatgttattcggacttcgattgaaattctaagttccttaccgtctgtggttgttggactgttcggttttctgattttcgttttacaattcaaattcgggttctcgattttatccggggccttggcattgaccgtcttcaacctcccgttgctgacgcgaaatgttgaagattcattacgcggcgttggctttgaacagcgtgaggccggcttagcgcttggcctatcgcgctgggagacggttttacatgttgtcatccctgaggcattgccggggattattaccgggatgattctaggtgccggacgggtttttggcgaggcggcggcgctaatttacactgctggtcaaagtgccccggcgctggatttcaccaactggaatccggctaacattgcgagtcccttaaatccatttcgaccggccgaaacgttggcggtgcatatttggaaaatcaactctgaaggcattcaacctgatgccgttgctgtttctgccggagctagtgccgtacttgtgatcgccgttttggtcttcaacgttggcgcccgctatttaggcaatcgactatttaaaaagatgacggcggcttaaacgggttaggcttctagtatcaatgaggcttacccggtatgataatcgcgataatacgtggaggcagaggatgcaagaactggaaaagtattcattagatgacacttatattcgaccatttgatcgcgaaaagcaggaaattgcgcttgaaacggaagatctgcatgtcttttatggtgataatgaagccattcatggcgtttcgctgccgtttgaacgctataaaatcactgcattgatcggttcaagtggctccgggaagtcgacatacttgcgctcactcaatcgaatgaacgataatattgaaagtgcgcgagtcaccggtaaaatcatgtaccggaatattgacatcaatagtgatgcggtcgatgtttatgagatgcgcaaacacattggaatggtatttcaacggcctaatccatttgccaagtcgatttacgacaatattgcttttgcactgcgtcggtttggtatcaaggacaaaaagaaactggacgaaattgttgaaaccagtttgaaacaggctgccttgtgggatcaagttaaagacgatcttaatcaaagcggtatgtcgctttccggtggccaggcacaacggttatgcattgcacgggcgattgccatgaaaccggatattttacttttggatgagccggccagtgccttggatccgatttcgacatcggcagttgaagataccttgttgtcattaaaagataagtatacgattatcatcgtgacgcataacatgcaacaggcggcccggattagtgactacacggcgttcttttatagtggagcagcgcttgagtatgatgaaacccgtaaaatcttcacgcgtcccaagattaaagcaaccaacgattatgtttccggacatttcggctaggaggttcccatggctgaagcacaaaaaatcattacaagttcagatgttcatcttttttatggtaagtttgaagcgctaaaagggattaatctggattttaacgaacatgagatcacagctttaatcggaccttctggctgtggtaagtctacgtatttacgaacgttgaatcggatgaatgatctgattccgggagtgacgattacaggaaccatcagtttacgcggtcagaatatctatgcgcctagtgaagatgtggttcaattacgtaagcaagtgggcatggtcttccaacaacccaatccgtttcctttctccatttacgaaaacgtgatttatggattgcgtttggcaggggttaaagataaaagcattttggatgaagcggtggaaaccagtctcaagcaggccgccatctgggatgaagtgaaggatcatctgcatgacagtgcattatcgctttcaggtggccaacagcagcgggtttgcatcgcgcgggtattggcagtcaaacctgatgttgttttgttagacgagccgacgagtgccttggatccgatttccagcacgcaaatcgaaaacatgttactcgagttgcgtgatcaatacacgatcattctggtgacgcatagcatgcatcaagcatcccgaatttccgataaaaccgcctttttcctgacaggcaacctgatcgaattcgctgacacgaaacaaatgtttttaaatccaaaagaaaaggaaaccgaagactatatcactggacgcttcggctaggaggggtagtatgcgacgactttttgttgacgaattgaacgatcttcatgtacgtttttcggaaatgggaatgatggttaatgaggccatctataagtccgtgaaagccttcatcaatcatgacaaggctttagcccgcgaagtgatccacgaagacaaacacattaacgagcgtgaagttgatttggaaaaacgcagcttcgaattgattgccttgcagcagccggtgacgaccgatcttcgggtgattgtcacggtgatgaaggcaagttccgatctggagcggatgggggatcatgccgtttcaattgctaagtctactattcgagttaaaggtgaaacccgggtaccgcaaatcgaagctgatattgccgggatggcagacgcggtaaaagagatggttgaacaggtgctggatgcctatgtgaaggaagattcagcccgtgcacgtaaaattgccttggaagatcacggtatcaatgacttttcatcgcggatttacaaagagtgtatccgccagatgcaggaaaaccccgaaaccgttgtcggatcaatggactatatgctggtttcgtcctatcttgaacgaatcggcgactatgtaaccaacatttgtgaatggattgtctacttaaagaccggtaagattaccgaattaaactcaaacgcaattgaagacaagttctagatcctggagacttttttgaacgaggctggggcatcattcattgtttcaaaatataagcgtaccatttctcgattttttaagaaatggtacgctttttggcttcttcatattagtataaatgagctttaacgattccagtgccaaagcggagcaatcgtaggctagatggggctcagccgtggaacaacacagcgaccggtttttgtcgcggggctgcttcgcgtcaagtagacaagtcaaataattaaaattgctatgcgatttctttcacggcatgattccgatattccagcggagtcatgccgtttagtgtttcctgacgtcgtttattgttgtaccaatcaacgcagcgctgaatcaattgcaccatctctaactctgacagagcatgttcgaacctgaagaattctgtcttcatgtggctccagaagctttccattggactattgtcacctggggtgcctggtcgagacatactgtgggtgatccccagcccgaccaatttcatattgtagccccgtgacgtataggcagagccttgatcactgtgcagtatatcgggtttgagtctaccagtattcttcagtgcggcctcaaccgtattggtgaccaatagagtcgtttctgttggtgatacgcgccaagccacgatactgtgatcgaacaagtccttaacggcacttagacgcagtctatactgcattcgatcaccataggtcaactcactacagtctgtcacccaaaccatgttcggacgctctggagagaagtcatgaccagcatcgttagtcagtaacttattggcaaagcagtattcttttttctcggcttttcgatcccgtttagcaacacgaatggcggccacgatatgatttttatgcatgatgtttctgacccgggtcgcaccgacatggaatcgtgtctcgcggttgatataaattactaatcgacggacgccaaagatgtagtgattatcttcttccaaagacttgatatactgagcaatttctttgttttcctgggcgtggaccgatggcttacggttgcgccatttatagaaagcagctcttgaaatctctaaaaattgacaggcaaagctgatgccataaggctgcttagtatcgagatttatttctttggcgagcgcctccacggtacgatatttttcttctgttgggcatccatcctttcgatttcctggagtttttttaatatggcggcctccgttgagacgtatttaagccgggccttgagtcgtttgatctctaggtccttcttttccatttcagtcagctgtccgttgtcttccttgtctttaccacggcgatcaagcaacgcgtctggtccgccctgtacatatttcttgacccacgaataaacctgaccataagagaccttgaagcgtttggtggcttcaatgtaatttttattgttggcaatcgtccattcggctatctcaatgcgttcagcttggcttgtgtcccgaccgtctttcacgggtgtacccctcctgttagtggtggctaaagatttaccactagtatacagggaaacccattgataaatcacaccatggttaggaataccgtactgtcgtgcaagagcaggggatgaagcttttctttcgagaaaagccttaatcacttctagcttgaactcttccgtgtagcgcgtatgagaatctctgggctttaggcccgcttccccctccgcttcatatctgtcaacccattgggtgatctgagcatggtcgatgccatacttcttttggactgctccagcagtcatccctcctgcaacaagaccaatgtaaaagagcttctccttcaatgtgtaacgtgaaccttttcggcccataagaaaactccttccaagtaaacgggttttaattatttacctgtctaccttagaaggagtataccccgctgatgttgttaggcgacttggagactgccggggcttgcaggctccaagcgccgtctccgctctagcttcgcgtcgccaccccatctggccggagattgcgtagtttggcacggcccggaattacttgagttactttctcagtcatagtattcggattttagtgcgcatcacatcctgagatagaattatgcctcagtcccttggcttattcatatgagtacaaatgagccttgacgattgcggcgtttggcgcgacacgggactatttgacttattttctagcgatgatattcgaatttggtgagtagcgaattctgaaatggagtgatgtcacaccctcgttcattccacctttttagaaagcagtgaggtgtcgagatgatcactaagttgcgcgtgtccgccttacgacctgtttaaaaatcaacctttggacctatgcgccttggccaaattccgtgcatactaatcatgtaatcaaatcctggagggataacccatgaatgaacgcgaaagaattttagacctcgttaaaaaaggcgtcatttcaagcgaagaggcgctggtgcttttggaaaacctcgcaaaacagcaaggtacgcaagccggcagcccggccgatgatactgctcccgaagctcattcggaacagaccgaaaccgatgatcaatcaacgcaggaacaacaagaagctaataaagatacggatgctgcattgacagagcttaacaccgaaattgccgaagccgctggtgccttggatgctgcgacggcgcaagtgacaagcatcggtaagcaaattgaagcgaataacgaacaaattattgttttagacacaatggaagatctcgaagcactttccccggaaaaatatcaaaagcgcggggaattgaagcaagagaatcagaaacttaacgatcagttagccgagctaaagggacaggttgaaaccatgaaggccaacctggcaacgttgcggcgtcaaaagcatgatcttgaacgccaaaagatcagtgacaaaatcttcaacgatgactggcaaaaagatgctcgtgatgtcttttcggagtttggcaagaatatcggggatgccacgtcacaactaggcggtttcgttaaggacactgtcaacaatgtcctggataatgttgactggaagaatgttactgtaacggttcccgggttggcgactgaaaaatttgaacatgttttcaagtttccagacagtcaggcgacgattctggatgtcaaagtggccaacggtgatgtgaagtttaagacttgggatcagccgggaattcaagtcgaagcagcgattaagttatacggaaagatggatgccgattcaccgtttgaagcttttaaagatcgtagccgcattgatgttaccgacgatcattttagcttccaggtgccaaataagcgcgtccaggctgatctggtcatttcgttgccaaagcgcacttacgaccacgtgtcagttcgtttgttgaatggcagtgcggatttaaccggtgtgaatggtaaagacttttatgttaagagcaccaatgggcaaatgaattttaccaatgtggacggtgtgatgattgaaagcgaaggcgtcaatggatcgattaaggttcaaggcagccatacccatgacttattgttgacgactgttaacggtgatgtttcagtcgatgccgatccggcaacagcagcattaaagacggtcaatgggacggttcgagccacttatcacacggactttaccaaaattgaagggacttccatgaatggcaatgtgaaagtggcggttccggcatctattgcactgaaaggtgaagcccgtacccattttggcagcattaagagccgacttagcaacgttgcggagccagccaaaggactcaagcgttttgagttagaccggcccggaaccggcaacagcgagttgaaactcaatacaacaagtggcaacattcaattaaaagattcaaatgactgaggggatcgcttatgccttttctaataattccaattatgttcttcatcgttggcctggtactggtggccgtgtttgcaatcggtattttcttgctaaaactgttaatcgttcccgccttgttagtggtgttagcggtttggctgttctcacgccatgatcatgagaaacggcaaggtccgcgccacccttatcgtgatcagagcacgtctcgtccgcgaaaaaacgcaacgcatgtgaccgaatcacgtgatgatgattggagcgatttctaatcatgaacttcatcaaacgcgcagttataacgacagctgtcttcctgatttatgcgcaggtgtttcctggtcagttgttcgttgcgagctttggtgttgccgttgtcggggcactcgttttaggggttctcaatggcttgttgcggccgattctggtcgttttgtccattccgattacgattttgacactagggttgtttctgattgtgctcaatgggctgatgttaagtatgatgacatggttcgttcccggaattgttttcagcagtttcgggtcaacgatggtacttgccatcatcatatccgttttgaatatgatctttgtcggcaagcattaagtcagtttaacgataaaagagtacgtcacgagattagcgttatgtaaaaataaatcggtcttaaagatgtttcctgtctttaaggtcgattttattttgtctaaaagattgggtagtggataagtgcgtggaaaatgcccattttcaccattgacatattaaacgccatcgtttcagaattaggcgaatgttttggggcgagctgctatgagggctggcgagttatggtaaaataaagcaaatacggcgaaagaaaggtggacttcatggcagacagcgtgacagtacggcaacttgtcaaagcgacaaagcttgaggtatacagcggctcggaatatcttgatgcccggcaagtcgttttgagtgatatttcgcgtcccggccttgagttaacgggttactttaattattatccacatgaacggattcaacttttcgggcggacggagatttcatttgctcgtaatatgtcttcagaagagcgtttattaattctgaaacggatggcaacagaagatacaccggcttttctggtttcgcgaggattgcagccaccggcagaaatgatcacggcagccactgccgcacatattccggtattaggatcacggttgccgaccaccaggctgtcaagcttgatcaccgaatacttagacagccaactagctgaacgtcgcagcatgcatggcgtcttggttgatatttacggtctgggcgtgctcattactggcgattccggggtgggaaaatccgaaacagccttggaattggttcagcgtggtcatcggctcattgctgatgatcgggtggatgtttatcagcaagatgaacaaacggttgtcggagctgcaccgccgattttatcccacttgttggagattcgcggattgggtatcattgatgtcatgaatctctttggtgccggtgcggttcgtgaagacaccaccatttcgctgattgtgcacttggagaattggacaccagacaaaaccttcgatcgcctgggctctggcgaacagacgcaaatgatctttgacgtgccggttcccaaaattacgattccggtcaaggttggtcgtaacttagccattatcatcgaagtggccgcgatgaatttccgcgccaaatcgatgggctatgatgccactaaaacatttgaaaagaatttaaatcatctgatcgaacataacgaagcgaacgaccagaagagttcggaggaaaaataacttgttattaacactcaatccaattgcttttcagttgggtgggctggaagttcactggtacgggattattatcgccagtgccgttttactggcggtttatctggcaatgaaggaagcaccaaaacgcggtattaaagaagatcatattttaaatctgattttatgggcgttgccatttgcgttaatcggtgcacgcctttattacgttgcttttgaatggtcttattacgcggctcatccaagtgaaatcatcgcaatttggcatggcgggattgccatatacggcgctttgattgccagtgtgattgtttttgcgatttattgtcgcgtcaaatggctgccggtttggctggtgttggatattgcggcgccaaccgtgatgttagcccaggcaattggccggtggggtaatttcatgaatcaagaagcccatggtgccatcaccagtttggcttacttgcgtggcttgcacctgccagaattcattattcaacaaatgaatatcggtggtgcttatcgccagccaaccttcttatacgaaagcatgtggaatctcgttggttttgctttaattatgacggttcgccatcaccaacactggtttaagcaaggggaaatcgtcttgggttatgtcatgtggtatagttttggacggttctttgttgaaggcatgcggacggattcgttatatgtcataccaggcttgcgtgtttcccagcttttgtcgattgttttattcgtggtggcggccgggctcatctggtatcgacggcggcgtggcgatgtcgcgtggtacttagacggtaatccactgcaggcggttgaataggagtgattttgtgccgacaaaaatagcggttttaggagcgggctcatggggaaccgtgttagccaatttgttaacggaaaatggccacgaagtcgatttatggagtcataatcctaaacaggttgcgaccatgcgagaaacccgcaaaaatgaacattatttaggtgcagaatttaccttacatgatgcgctgcatgtcacggctgatttaggccaagcattagatcaagccaatgtgattcttttcgttgtgcctaccaatgcgattcgcagtgttgccgaacagattagacccattctgcaggctcatcgtggtcgtggtgaacagccgattattgttcatgcagccaagggattggaacgcggcagtgagctgcggatttcacaagtcttagctgatgtccttcctaaagaactcattcaaggcatcgtggtgatttcgggtccaagtcatgccgaagatgtagcgactcatgatatcacaacgctgacagcagcatcggcagacttatcactggcaaaaaaagtccagcggttattcatgaatgactattttcggttgtacaccaatactgacgtgatcggagttgaaatcggagccgctttaaaaaacgttatcgcaatcggggctggcgcgttgcatggtctcggatatggcgataatacgaaagctgctttaatgactcgcggcctggcagagatcagtcgggttggggtcaagttaggcgcagacccgttgacgttcatcggtttatccggcgtcggtgatttgatcgtcacctgtacatcggttcacagtcgtaattggcgtgccggtaatgcccttggccaaggtgagaaacttcccgatgtgttgaaaaatatgggcatggtggttgaaggtgtttcaaccaccaaagttgcccaccacatggcaagtgagttgggtgtcgatatgccgatcaccgatgcgatttatcaggttttgtatgaagacgcgccgattcgaacggtgattaccgatctcatgaagcgaaccggcaaacctgaatttgattttgataatgccagtttacaaaaaccataaaaccctgtatattagaacatgtagcttactatttgtaagcaataaggcaaaaggagagacagcccatggcaaaaaaatatgatgtaatcgtgatcggtgccggaccagggggcatgacagcagcactttatgcttcccgagccaacttatcagtgttaatgcttgatcgcggcgtctatggcggtcagatgaacaataccgccgaagtagaaaactatccgggttacaagtctatccttgggcctgatcttggccagaagatgtacgatggtgcaactcaatttggtgccgaatatgcgtacggcaacgtgatcagtgtccaaaatcacggcgctaccaagttggtcaaaaccgatgaagacgagtttgaagctaaagcgattgtcattgcgactggcgctgaacacaaaaaactcggtgtacccggcgaagaagccttcagtggccgaggggtatcgtactgcgcggtctgcgatggtgcgttctttaaggatcgtgaacttgcagtcattggcggcggcgactcggccattgaagaaggactttatttgacgcagatggccaaaaaggtcaccgtcattcatcgtcgtgaccaattacgggcacaacaaatcattcaaaagcgagcctttgcaaacgacaagatgcattttgtctggaatgcccaggttcaggaaatccaaggcgacgatatgaaagttaccggcgtcaaatatcgtgataaagaaaccggtgaggaacatgttttgccagttgccggtgtcttcatttacgtcggcatcatgccaatgaccgagccattccaggatctgggaattctggacgatcatggctggattccaacggatgaacacatgcgaaccaaggtgcctggcatctttgcgatcggcgatgttcgcgccaaagatttacggcagattaccactgctgtcggagaaggcggcaccgctggccaaggcgtcttcaattatattcagagtttgaatgataccagtgttgaagtaaaagcctaagttttgacgagtcttttaagaccattcaccaattgaatttgatcaaggaacggttctggcagacacgaaaatctgttaggaccgtttttgcttttaaaaataccacgctattgcgaatatgatggcaaaaatcgtaaaagaattttcttatttgagcgcgttttcaacccagcgttggtcacttatagtatgattggacagggaagggtagtacccgaaattatcaatttagacagataggagctgatcacgtgagttatcgtgatacgtatcaacaatgggtagatgaaccaacgcttgatccagagctaaaagctgaccttaagaaaatggcagacgatgaaacaaccaaagaagaagcgtttgcggaaccaatggcatttgggactgccggcatgcgcggtgtgcttggtgccgggatcggccgcatgaatatttataccgtccggcaggcgactgaaggcttggcacggtttatggataccttgactgacgaaactaaggctcggggtgttgctattagttacgattctcggtacatgagtcaggaatttgcctaccaaagcgcaggcgttctcggcgctcatggcattaagagttacgtctttgatcaactgcggccaacaccggagctgagttttgctgtccgtcacctgaagacatatgccggaattatgatcacggctagtcataacccgaaacaatacaatggctataagatttatggccctgatggcggtcaaatgccaccggaagagtctgacaagattaccaagtatgcccggtcggctgatgatctttttgccatcaaggccttgaatgttcatgagttgcgggctaaggatttgatgcagccaattggtgaagatgtcgatgaagcgtattatgctgaagtcgcaacggttacgattaatcatgatttgatcaacaaggttggcaagaacatgtcgctggtttatagcccgttacatggtaccggtcggattccggcacaaatggtcttgcgtaatgccggatttgaaaacttccggttggttgcgaaacaaagtgttgctgatccggaatttgccacaaccccattcccaaatcctgagtttgcccaagtctttgatttgccaattgaactcggcaagaaaattggtgccgatgtcctgattgccactgatcccgatgctgatcggctgggaactgcggttaaagttggcgatcactatcagttgttgaccggtaatcaaattgcgtctgtgctattgcattatattcttgaagcacgtaaacaagccggaaccttgccaaagaacggtgcggtcgttaagtcgattgtttccactgagttggcaacggctattgccaaagattatggcgtggacatgatcaatgtgctcaccggcttcaagtttatcggtgatcagatcaaacatttccaggcgactggcgaacatgaattcctgtttggctttgaagaaagctatggctacctgatcaaaccgtttgtgcgtgataaggatgccattcagtcaactgttttgctagccgaagtagctgcttactaccagtcacaaggaaagacactttgggatggcgttcaggaactgtacaagaagtatggctactacgctgaaaagaccgttggcgttgattttgaaggcgttgatgggcctaagcagatggctaatctgatgactaaattccgtgaagaacagccagatgattttgctggcgttaagatcgcgaaagttgaagatttcctgagccaagaagctaagtctgcagatggcacagttgaaaagctgacgatgccatccagcaatgtgctgaagtatattttggctgatggtacctggattgcaattcggccatctggtacagagccgaaagtgaagttctacgttggcaccaaagccgatacggatgcaaaggcgcaagaaaagcttgatgcctttgagaaagctttggatgcttttcgtaaggaagcttagatgaacgattcgcgtggtcagcggttgctgttgtgctagtgaatgcaatgtgataatcgcggataaaagtgtattttaaccgatcgatcctaaagggaagcctttggggtctatttttgatttgtcttaaatgcagtagccgtgacaataaagatagcgccagggctagaagtatacgggaaagtgagcgtttccggtttccgttgctgatttctttttctgggggggtcgttgtggctggtctagcgctttgatcaatgttcttcgcattcatttttgggatattggctgataccctggagtggaaaatgtttcagggctctaattggttctaacagcgccggttcacgctctctttttgtgaattttcttgcaatggcttcttgatggtggtagtcttttaacaatttaagtaaatttcacgatcagacacgacaactatcaggaggtcatttcgaaatgggcatgcaccaatttatccaaggactgagcaatctggaaacactgcggcgggcaccgggctttttcaagtatcaggagcattcggtggcggctcacagtttcaaggtggcggagatcgcgcagatgttgggcgatgttgaggagttagctggaaacaaggttaattggcagatgctctatgagaagtcactcaatcatgattataccgagcgcttcatcggtgatattaagacgccagtgaaatatgcaaccccaacgttacggcaaatgttggctgacgttgaggctaccatgacggaaaacttcatcaaaaatgaaattccacgcgactttcaggatcgttatcgtcggcggttatctgaaggcaaagacgaaacgctcgaaggtcagatcctgagcgttgcggataagattgatttactgtatgaaggttttggggaaatcgaaaaaggcaatccggagcaggtttttctcgatatctattcggaaagtttaagtactattttgcagttcaagaatcgtccgagtgttcgctactttcttgatgaagtattaccggatatgctggatgagaagttcgccagtcgggatcaactggctaaattgactaaagaaaccatggcagaacatgagactggcaagtagcgaaagtatgttcgctatgttataatatgcaggatgaaagttgggatgcgtttcttatcggttccaacttttttaatgagaaggttttagtgtggttgtgagctttgcgttggccggttagcgctcgccataacgcgttcaccgggccagaaacctgcacataaggaccttggtcgcaatgaccaaacaccggtcattacgcccaaggccgcttatgctccggtttctaaccgggctggctcacgctcacttttctttggaggtacatcgatgattgaacgaattgctgatcgtaaatttgatttggtttcgccttataagccagccggggaccagccccaggcgattgctaagctgactaaggggtttgaagaaggtaaaaaggcgcaaattctgttaggtgcaaccgggaccgggaagacgtttacgatgagcaatatcatcgccaacttgaacaaaccgactttgattttatcgcataataaaacgttggctggtcagctgtatggtgagtttaaggagtttttcccacataacgcggttgagtacttcgtgtcttattacgattattaccaacctgaagcctatgtgcctagcacggacacttatattgaaaaagacagtgccattaatgatgagattgataaattgcggcatagcgctaccagtgcgttgcttgagcgtaatgacgtgattgtcgttgcttcggtatcttctatctttggtttgggtgatccgcatgaatataagaaccatgtgttatcgttgcggactgggatgaccattgaccgaaatacgttgttgcggcaattagtagatattcagtttgatcgtaacgatattgattttcaacgcggtcgttttcgggtacggggagatgtggtggaaattttcccagccagtcgtgatgatcacgccatccgcgttgaatttttcggtgatgaaattgatcggattaccgaagtcgatgctttgacgggtgaagtgattggtacgcgagatcatgttgccattttcccggccactcatttcatgacgagcgatgaacagatggaacgcgcaattaagagtatttctgcagaactcgaggatcgcttaaaagtcttgcgcggtgaaaataagcttctagaagcccaacgattagagcagcgtactaattatgatattgaaatgatgcgcgaaatgggcttcaccagtgggattgaaaattactcgcgccacatggatggtcggaaacccggagaaccgccgtatacgttgctcgactttttcccgaaagactttacgattatggttgatgaaagtcacgttacgatgccacaggttaaaggcatgtataatggcgatcgggcccggaaacagatgttgattaattatgggttccgtctgccaagtgccttggacaatcgacctttgaagattgatgagtttgaaaaacatgtcaaacggattctttatgtgagcgcaacgccaggaccttatgaactgagtcgcgttcctaaagaagatattgctgaacagattattcggccgaccgggttgttggatcctaaaatcgaagtgcgtccggtgatgggccagattgatgatctggttggcgagatcaacaagcggattgatgcgcatgaacgagtcttcatcacaacgttaaccaagaaaatggcggaagatttaaccgactatcttaaggatatgggaattaaagtccgttatttgcatagtgacattaagacgcttgaacgaacccagattattcgtgatttgcggctaggtaagtttgatgtattgatcgggattaaccttttgcgtgaagggattgatgtaccggaagtatcattaattgcgattctggatgccgataaggaaggcttcttgcgggcagagcgttcgctgattcagacgattggccgggcatcgcgtaatgaacatggtaaagtcattatgtacgctgacaaggtcacggattcgatgaaagccgcgattgatgaaactcggcggcgacgggcaattcaagagaagtttaacgaagagcatcacatccaacccaagacgattattaaaccgatccgggcggctatttcaacctatgagcaatcggatgacgaaaaagccgatgccaagaagacttttgcagaagttgattacgaagatatgagtaaagcagataagaaagaactggttgccaacctccgttcacagatgcaggcggcggccaaaaagttggactttgagcaggcagcttctttgcgcgatacgattttggaattgcaagcggatatgtcttgagaatgaggtggacaggacttgcatgatggcaccaactcagccatgattgctatgagcagatccggcgatcatggctgttttcttgctttcgaattaggcataagtgctgaggcatttctagtttgtatccgccagtgctaccagttgtcggcatgttttaattgaggagatcttttgtgaatggcaaatgataaaattgtaatccacggggctcgggcccataacttaaagaatattgatgtgacgattccgcgcaataagcttgtggtcatgacgggcctttcaggttccggtaagtcgagtctggcgtttgatacgttatatgcagaaggccagcgccgttatgtcgaaagcttatctgcttatgcacgccagtttcttggtcaaatggagaaaccggatgttgattcgattgatggtctcagtccggcaatttcgattgatcaaaagacgacttccaagaatccacgctcgacagttggaacggtcactgaaatcaatgactacttgcgactgttgtgggcgcgggtcggtcatccgatttgtcctaacgatgggacgccgattaccagtcaaagtgttgaacaaatggtggaccgcgtcttggctttgccggaaaagagccgcattcagattctgtcaccgattgtgcggcggaaaaaaggcagccataagaaagtctttgccaaaattatgcgtgaagggtatgtccggatgcgcgttgacggtgaagtcatggatgccacagcggactatgaactagacaaaaacaaagcccatgatattgatatcgtgattgatcggattgtggtgaagccagaagcccgcagtcggttatttgactcttttgaagcggcgttgcggctttcggaaggatacgctaatgttgacgtcattggtggcgatacactgcgtttttcggaacattttgcctgcccgatttgcgggtttacgattggtgaaatggagccgcggttattttcgtttaatgcgccatttggagcgtgcccggaatgtgacgggctgggtgtgaagttgactgttgacatggatctggttgtaccggatccaagtatgactttagctcaaggtgccattgccccatggaatccgattagttcgcaatattacccggaactgttggcacaagcggcaactgcctttaaggtgcgaatggatgtaccgtttaaaaaactaaccaagcgcgaacggaatgttgttctcaatggcagcgatggcaagccattccactttcattatgaaaatgacttcggcggtgttcgtgatgttgatgtaccgtttgaaggcgttttgaccaacatttcccggcgttatgccgagacaaatagtgacttcacccggcaacagatgcgcagttatatgacggccttgccttgtccggtttgtcatgggaaacggctcaatcgacaggcactcgcggtcaagatctctggacgtgacatcgctgaagtatctgacttggccattaaggatgcgctgccgtttttcaagcaaatacatttgagcgaagccgagaccgtgattgctcagccaattgtcaaagaagtggtggatcggttaacttttcttgtcaacgtgggcctcggctatttgaccttaagtcgaagcgcggggacgctgtcaggcggtgaagcgcaacgaattcgattggccacacaaatcggttctaatctaagtggtgtgatgtatgtgcttgacgagccatctattgggttgcatcagcgcgacaacgaccgtttaattgcctcgctgaaaaaaatgcgtgatttaggcaacacgctaatcgttgtggagcacgatgaagacacgatgcgtgcagccgattatctaattgatgtaggtcctggcgctggtgagcatggtggccgaatcatggcatcaggaacccccaagcaagtcgcccgcgtgcgtaaatcaattaccggccaatatttatcgggtcgcaagtttatcccggtacccttaaaacgacggccgggcaatggcaaagtgattcggctggaaggtgcgtctgatcacaacttgaagcatatcaatgtcgattttcctttaggtaagttcattgttgtttccggcgtctccggatcaggtaaatcgacgctggttaattcgattttgcggcgggcactggcgcaaaagttaaaccacaattccgaaaaacccgggccatatgataagattctcggctataaaaatatcgagaaactcatcaacattgaccagagtccgattgggcgtacaccgcggagtaatccggcaacgtataccagtgtttttgatgacattcgcggtttgtttgcggaaaccaatgaagccaagttgcggggttataaaaagggacggttcagcttcaatattaaaggcggacgctgcgagaattgtaaaggcgacggcatcatcaagattgaaatgaacttcctgcctgatgtttatgttccgtgtgaagtctgtcatggcaaacgatataattccgaaaccctggaagtcacttacaagggcaagaatattgctgaagttctggatatgaccgttgaagaagcaaccgcattctttaaaaacattcctaagattcgccgtaagttacagacgattgtcgacgtcggattgggttatgtgaagcttggtcagagcgccaccactttatccggcggggaagcacagcggatgaagttggcaagtgaattgcaaaaactatcaacgggtaaaaatttctacattctcgatgaaccaacaacggggttgcacaccgatgatattaagcggttgttggagatcctcgaacggctggtggatgaaggtaacacagtcttggtgatcgagcataatctggatgtcgttaaaacggctgattgggtcattgacctaggaccggaaggcggagatggcggtggtcaagtgattgctaccggtacacctgaagaagttgccgaggtggctgacagttacaccggccagtaccttaaaccggttttaattcgtgataccaaacggacaaaagaagccgcggccggttcgtctaagcaggcaaaagcggctaaaacatcgacgaaatagcatcataaatagtcgcgtgaaaagcgcgactatttatgtacataacaaacgtttggctttctttgagtttgacgaaaaattatccaccgcgacttcaagccggaactttggggtggaagtcagtaaacagccaccttagacactttttaaattgctttttgaaatggtatgattgaaacgattaagaaagtagggaattaaatgttaaatcgaaagagttttggttttgactggggacagtttatcactggtattttattcctgatcgctgcttttgtggttttacgctatccgttagccactttaaaaaccgttacctttatttttgcggtcgtggcgattattcgtggcattgcgattcttgccggttattccaccttgcgccagtttacaggtaagttagcgtggatttccttactgatggggatttttgatctcgttatcgggttggttttcctgttaaatgccggctttggaatggtaacgattaccatgatgtttgcaatttggttcttggttgattctgtcgggtcattatttaacgtcggccatctgcgcattgccggtaccggctggttcattttatatttgatcttggacattctggcagtgattgtttcactgatgttattcatgcagccggttgttgcagcagtcaccttagtcacactgttggcaatgttcttcgtcttattcggaatcgaatgtatcgtgattgcgttcgcccggcggaatatttaatgtttcattagaacctgatgacgtggtgatcaaaccgtggcattgggttttttagtaagcgtgagccagcccggttagaaaccggagtgtaagcggccttggacgtgatggtcgggctttgaccattgcgtccaaggtccttacacgtaggtttctgggctggcgaacgcgttatgggcgtaagctagaatataagcggcctcaggcgtgatggccagtctttggccattgcgcctgaggtccttacacgcagatccctgcgccggggagcgcgttatgggcgtaagctagaatataagtggcctcaagtgtgatggccggtctttgaccattgcgcccaaggtccttacacgcagacttctgcgccggggagcgcgttatggagcgtgaaagccaccgactcacggatcgcaccgctgcaagagaaaagtatgaagcagtatgaatgacacgcccggaatgttatactgtatagaatatgatcacaaaggagccgtttatgactgaaagtttggatcttgttattattaccggaatgtctggcgcaggtaagactgtcgccatgcaagcatttgaggatttggggtacttttgcgttgataatatgccacctgcactattgcctaagttttgggaattggtgaaagaatctggcaagatctcaaaagttgcacttgtcgtggatctgcgcagtcgggctttttacgatcaaatcatcgatatgctggcaaatttagataacaatgcatatgttcattcccgaattttatttttggatgctaccgatgaagaattggtatcccgttataaagaaacccgccgttcccatcccctggcaatggaaggccggttgatggatggcattaaaaaggaacgggtgttattaaccgagctgcgtaatcgtgcgcaagtggtcattgatacgaccactttaagcccgcgacagttacgcgaaaaaatcttcctgaacttcaaagaaaataatagccaaccggcgtttcatattgaagtcatgtcctttggttttaagtacggcttaccgattgatgccgatattgtgatggatgtccggttcttgcctaatccgttttatatcaaggcctatcgcccgaaaaccggcttggatccggacgtttatgattatgtgatggacaacgaagacgcggaaagtttttacaataagttttacgctttgttggccgaaatcatgcctaagtataaggctgaagggaaaaccagcgtgaccattgctattggctgcaccgggggacaacatcgcagcgtagcgtttgcagaacgtattggcaaagccttttccgatgcttatgcggttgacatcacacatcgggacattaagaagcataaggagacggtgaatcgttcatgagtcgtgaaactaaatttattcgggttattcgcggtcggcgtcctaaagttgtcgtgattggcggaggaactggcttaccggtgattttgcatagtttacatgagcaagatgccgatgtgacagcgattgtgacggttgccgatgatggcggttcgtcagggaagattcgcaattatattaatgtggtgccgcctggtgatattcgcaacgttttggttgccttatcggaattgccgagtttgtatctggacatttttcaatatcgctttaatacgactgatgctttttttgccggtcatgcgattggaaatttgattattgcggctttgtcagagatgaaaggcggcatttttccggctgtgcagcagttaagcgagatgatgcaggttgatgggcatgtctatcccgccagcaatacgccgctgaccttgaatgccgagtttactgacggtacaaggttgtccggcgaggcggaaataaccgcagccgggaagaacattaagcatatttccgtgtccgagactgatccggctaatggtgaacccaaagccgtccaagaagtgattgatgcgatcatggatgcggatgtggtcgtgctgggaccaggcagtctgtttaccagtatcttgcccaacttgatgattggtaaccttggggatgcggtgaaaaagaccaaggcagaagtgatctacattgttaatatcatgacgcaaaaaggcgaaacccaaaactttaccgatgccgatcatgttcgcgtcttaaacgagcaaatgggggagaattttgttgatacggtgttggtcaatattgagccggtaccggataattatttggatcaccaaaaatataacgaaattttgacgccggtgaagcataattatcagggactacgggatatgggctgtcgcgtcatttcagaagattttttgaaactgcgcgatcgtggcgttttccatgatggtgataaggtggccaaggagattttgaacttagcctttcaagtaagtgccaaaacgcggaggtgagcgcatggcaagctttgccagtattgtgaaaaaagaactgacgcaactggaagttcatcctgagcatgctaaggcggagctgtcggcattgattcgaatgaacggcagtctaacgttgatggcacatcggtttgtgttgaacattcaaacggagaatcccgccattgcgcggcgtatttatagtctgattcgccaagtgtaccatcacgaagccaacttggtcgttcatcgaaaaatgaagcttaagaagaattaccaatatattgttcgattgacagaaggcgtcaatgatattctgtctgacctggctattttggattcaaccacgatggccatttcaacgactgtgccagccagcgttttaaaggaaccacaacgcatgcgctcgtatttgcgcggcgcctttttggcaagtggctcggtgaataacccggaaacatcgcgctatcatctggaaatctattcattatatgccgatcacaacgcaggtattttaaaaatgatgaatcattttcatctgaatgcgcggaccgttgaacgtcgcagcggctatatcgtttatctaaaagaagcggaaaagattgccgattttttgcaggtcattggcgctaccaatgcgatgcttaaatttgaagatattcgcatcgtgcgcgatatgcggaattccgttaatcggctggtgaattgcgaaacggctaatatgaacaaaaccattgatgctgctcaaaaacagatcgagaacattaattatcttaaagatcatgtcggtttagataatttgccaactaaattacgcgaaattgcagtgttgcggttggcgcatccggatgtgtccttacaagaattaggggcaatggttcctggaggtacgatttcgaagtcgggggtcaatcatcggttgcgcaagttgaaccaaattgctgagggatatcaacaaccagaagatgcttaagccgaatcgatcatataaaaccgttaatgcccgattgaccggtaaaataatacctttgtttcctcaagataatcgtgtacaatgtaaccgacaccaagcgttatggtgtgtgtttttgtaggcaaaatatgtgccggtttagtttaaattcacggacataacgccacacattttgtcaaagcaactttactcacgcatggcagcgattgccgattattttcgacgatatccggaatgttggatgcgacaaagtttgatagtttttgcttcaatttttaggaggaaacatcatggtcaaaccgattacattagatgaacaactgtgttttgcaatttacaaggcacaaaaacaatataaccatttttacgcgcaggcattggcaccgtttaagctgacttatccgcaatatatcaccctgttgtctttatatgaacacggtacgatgtcggttaaacaagtcggacaaacgcttgaactggacagtggtaccttaacgccattgatgaaacggctggagaaagacggttggatcaatcgcaaacgctcaactgaagacgagcgccgagttgatgtgagcctgacgaaaaaggctttggatgcccgcgatcagatttttgaacatgttggctcgtgcatgaaactaatgaatctgccgcagtccgaatatgatcatattaaatccgaagtagcgcgggtggacgaacatttgagtgctatcgctgataatgcctatcccgaagcataaatcttcccaataaggtcaaagattgtgatgaaaatctttgaccttatttgactttagcagtatacttagcactgtactttaaagagtgctaaaaaacgattttttcaggaggttaggacatgctagtacctaccgtcgttgaacaaactagtcgtggcgaacgcgcttacgacatttactcacgtctattaaaagaccggattatcatgttgtccggtgaagtgaacgatcaaatggccaactctgtcattgcacagctgctttttctggatgctcaggattctgaaaaggatatctacctatacatcaatagtcctggtggcgtgatcaccagcggtctggcaatgctagatacgatgaacttcatcaagtccgatgtgcagaccattgcaattgggatggcggcatccatggcctccgtcttattggctggtggcactaaaggcaagcggtttgcattaccgaactcgaccattctgattcatcagccttcaggtggtgcgcaaggtcagcaaaccgaaattgaaattgcggccgaagaaattttgaagactcgcaagaagatgaaccagattttggccgatgcaactggtcaaacggttgagcaaatcaagaaggacaccgaacgtgatcactatatgagcgcgcaggaagccaaagattatggcttgattgatgatattttggtcaataagaacaaccaaaagtaagtttaaagcgtttaaacccaccgaccttcattaggcggtgggtttttgtttggcataaaagcgtttgtaggtttgacagcaggggcctttttggacgttgagcacgtacattaacggtgtaagattgagatgtcgggtttctatgtataattgtgacatgttcagaattgctttcaggccaactcctttgtttataggcagcaacctatgtaaaggtatgaatgctaatggcctaagtcttggcatcgcctccaaagtcgttcattccaaaaaagacttgcaaagttctgattgattgagtaatataattaagtacttgcgcggttagtgtaatggatcgcacgtgagattccggttctcgaaatccgggttcgactcccgggctgcgcagaaacccagtcaaatgggaaaagctaggaacagtaaaagcccgctacggtgggctttttgtttgccggaaaagtagggaaaacgaatttatgtgcaattttatgtgcaatggacctaaaaaagcgtctaaaaaattggttattgcacatgattgcacacacatagctgaatcgactatggtacaagcaatacggcggacacagtgatttaaaaacctaattggtagcgtatgggttgcggctgactcaataatttgagctggaattaaacatggagtgggaagactggaagactccttaatttagtgaaatatctggtggcacccgttatgcgattacaaacaggcttagcgggctttgtcagtaacaagatagttcttcatgaaagccgaccaacaaatacttaatttacaagtgaaaattgctcaaaacagaacatgtctcggtgaaagaagcgcgtgttaggtatattcgggagcctgaaacagtcacacagaaactgcatgaaaatttcattagaacccacccgaaacctgcgttatcaaaaggccgattcagggtcatcgggaaagctaaaaaccgaacacttgaagaattttcgaattagatgttcaaacttagcgggttttgtgattactttaagtcgatttaggcatcagacttgcgataaagcggaacccctgctacaattggttctgttggtaagggaaaacagcaaatgttggattcctaatttttttcagcttgctgggtcggaaaacgactcggagggacgtggaatgacccattaaagaaggacgtgccttatgcatactgaacttgcgtggctcaaagcgatcgcgcctgatctgatgggcgttgtcactaaacgctatcaggtccttcaatttattaactggatggcaccagttggtcgacgaactttagccgaacagatgaagatttcggaacgtgctttgcgtacggaaacggattttttacgcggacaagggcttttggaaagctctaagtccgggatggtgttaacagctaaggggttggaaacttttcatggtctcgatcatctgatgaaccaactactgggcatcaaggatgatgaaaaacgactcgcaactcatttggagattgaccattgtctggtcgtttccggagatgcggatcaaagcagccgagttttagacgaacttggtaaaacgctgaattcaaccttacaattgctgttgccgcccggtcacctgacaattgcggtgatgggcggtacaacgatggctcatttggcttcgcagttgacgtttcaattatctgccggccgtgaactatcatttgttcccgcacgtggcggtctcggtgaggctgtcacgattcaagccaactcgattgcggctgcaatggcagaagcaaccgatagcaaataccgagcgttatatgttcctgaaaacctcagctcggaatcctacgagtcattgattaaagagccatcggtaaaagaggttttaacacttatcgataaagcccaagtcgtgattcatagcgtaggtgatgcacttgttatggcgaaacgccgtggcatgtcacctgatacgatccgcatgttgaaagccaaacatgccgttgccgaagcatttggtgttttctatgatgcagagggcaaggtcgtttacaagataccgcaaatcggattacaacttgcggatcttgatcatattccgtatgtcttcgcagttgcggctggtaaaagtaaagccaaggcaattgcggcgtacatgcaacatgcaccgagtcggacgtggctgttaacagatgtcggtgccacaaactcgattttaactggggcaacccgttagaataaaaccttatttcctaaaggaggaaattttagcatgactgttaagattggtattaatggttttggccgtatcggtcgtttggcattccgtcgtatttacgaattgggtgcaaagagcaatgacatccaggttgttgcgatcaacgatttgaccagcccaaccatgctggctcacttgctgaagtatgattcaacccacggtactttccctggtgaagttagtgcaaccgataacggtattgtcgttgacggtaaagaataccgtgtctacgcagaaccgcaagcccagaacattccttgggttaagaacgacggcgttgactacgttcttgaatgcacaggcttctatacttctgctgaaaagtcacaagctcacttggatgcaggcgcaaagcgtgttctgatttctgccccagctggcaagattaagactatcgtttataacgttaatgatgacaccttgaatgcagacgacaagatcgtttctgcaggttcttgcacgaccaactgcttggcaccaatggcttacttcctgaaccaggaattcggcattgaagttggtaccatgaccaccgttcatgcctacacctcaactcagatgttgcttgacggcccagttcgtggcggcaacctgcgtgctgcacgttcagcagctgctaacacgattcctcacagcactggtgctgctaaggctatcggtttggttatcccagaattgaacggcaagttacagggtcatgcacagcgtgtttctgttgttgacggttccttgaccgaattggtttccatcttgaagaccaagaacgttacggctgaccaagtcaacgaagctatcaagaagcacaccgaaaacaaccctagctttggctggaacgaagacgaaatcgtatcttccgatgttatcggtacgacatacggttcaatcttcgatcctactcagaccgaagttacaactgccggtgactatcaattagttaagacggttgcttggtacgataacgaatatggctttacttgccagatgatccgtaccttgctgaaatttgctactctctaatccggagtaacgcttttctaaccgcaacatccgaagcggagggagctttactccctccgctttttttggaaagaccattaaaaggtgcttttatcagtgtcgctttggcctttgtaaacgagatgttgattgtaagcttaattgaagcatcatctttaggaaaatgaaggaggtcatatcttttggctaaattaatcgtttcagatttagacgttaaagacaaaaaagtcttgattcgcgttgacttcaacgtgccgatcaaagacggcgttatcggtgatgacaatcggatcgtggcagcattgccaaccatccaatatgtcattgatcacggcggcaaggcaattctgctgtctcaccttggccgggttaagaccgaagaagataaggcaaagctgaccttgaagcctgttgcagaacgccttagtgaattgctgaagaagccagtgacatttgtaccagctacccgtggtaaagaattggaagacgcgatcgcaaagttaaatgacggcgacgtacttttgatggaaaatacgcggtttgaagatcttgacggtaaaaaagaatccggcaacgatcctgaactcggcaagtactgggcaagcttaggcgacttgtttgtcaatgatgcctttggtaccgctcaccgtaagcatgcttctaacgttggtattgcctccaacatgaaacaaactgctgccggcttcttgatggaaaaagaaatcaagttcttgggtgacgctgtggacaatccaaagcatccattcatcgcaattttgggcggtgctaaggtttccgataagatcggtgtgattgaaaacctggttcctaaagctgacaagattctcatcggcggcggcatgacttataccttctatgctgccaagggtatgagcatcggtaattcactggttgaaaaggacaagatcgacttagctaagaagatcatggaccaagccggtgacaagctgcttttgcctgttgattctgtggttgccccagaattttctaacgatgcaccgcataaggttgttgaaggcgacattccggatggctacatggcgttggatattggccctaagacgattcaggaattcaaggatgcacttaagggtgccaagacggttgtctggaacggcccaatgggtgtctttgaaatgagtaactatgctgaaggtacacttgaagttggtcgtgctcttggtgatttgaaggatgcaactacgatcatcggtggcggcgactcaacagctgcagctaagcaacttggcattgcacctaagattacccacatctccactggtggcggtgctagccttgaataccttgaaggcaagaccttaccaggtattgcagccatttctgacaagtaattgttagtgatgctgatctaacagtcgttatcgacatgcaagatgcatgtcggtacataatgaaaggaagctatgtcatgcggacaccattcattgctggtaactggaaaatgaataagaatcctaaggagacgcaagccttcttagatgctgttaagggtaagttacctgatgcaagcaaagttgaaacagtcattggcgcacctgccattgatctaacgacgctggttgccggtgcagaaggtactcctttgaagacagcggcggaaaactgctactttgaagacgaaggtgcttttaccggcgaaaccagcccgaaagccttaaaagaaatgggcgttgattacgtcattatcggtcacagtgaacgtcgcggttatttccacgaaaccgacgaagatatcaacaagaaggctaaggccatctttaagaacaatcttttgccgattatctgctgtggtgaaagtttggctcagcgtgaagccggtcaaaccgaagattgggttgcttctcaaatcgaagcagctttggcaggcttaagtgccgaccaagttaaggtttcggttttggcttacgaaccaatctgggctatcggcactggtaaaacagcaactgcagatcaagcacaagaagttgttgctcacatccgtgcaaccgttgagaagttgtataataaagatacggcagatgctgttcggattctttacggcggctctgttaaaccagcgaacgtcaaggaattaatggctaagcctgatattgatggtggcttagttggtggcgcttcgatggatcctgacagtttcatcgccttggctaactaccaagattaatctggtttcaatattaaacagccttctggcaaaaaggagaagaatatatgtctatcattactgatgtattggcacgcgaagttttagactcacgtggcaaccctactgttgaagttgaattgtataccgaagatggcggtttcggccgcgcattagttccatcaggtgcttcaaccggtgaacatgaagccgttgaattgcgtgatggcgataaggatcgttttggcggcaagggtgttttgaaggccgttgaccacgtaaacaatgaaattgctaaggctgtgattggccttgacgtcaccgaacaacgcttgattgaccaaaccatgatcgatcttgatggcacgcctaataaaggcaagctcggtgccaatgcgatcttgggtgtttccttggctgctgcccgtgctgcggctgatgaagttggtctgccattgtatcaatatcttggcggcccgaatgctcatgttttgccaacgccaatgatgaacgttcttaatggtggtgcacattcaactaacaccgttgacttccaggaattcatgatcatgcctgttggtgccaagagtgttcgtgaagccgttcggatgggttcagaaaccttccacgcattgcaggcactgctcaagagcaagggtgacatcactgctgttggtgatgaaggcggctttgcacctaacttgaaggataacgaagaagctttcgaattgcttgttgaagcgatcaagaaagctggctacaagccgggtgatgacattgctttagccttcgacgttgctgcttcagaaatgtacgatgctgataccaagacgtacacaaccaagtggtccaacccagacaagaagtacacaaccgaagaatggaccaacatgattgacggctacattaacaagtatccgatcgtttctgttgaagatccaatcgatgaaaacgactgggaaggttggcagacattcaccgagaagatgggcgacaaagtccaaatcgttggtgatgacctgtttgttaccaacaccgattacctgaagaagggtattgacatgggtgttgctaactccatcctgatcaagttgaaccaaatcggtacattgacagaaaccttcgaagcaatcgaaatggccaaagaagctggttacacggctgttgtttcacatcgttccggtgaaaccgaagataccacgattgctgacttggttgttgcaactaacgccggtgaaatcaagactggttcaatgagccggactgaccggattgccaagtacaatcagttgatgcgcatcgaagatcaattaggtgctcaatcacaatacaagggtcgcaagtccttctacaacgttaaagcaattgactaattaacgcttgacgttaacatgaaaagcacgtcacttcaaatggtggcgtgttttttctattcttagcttaagcaaaagatgaacttgctcacgcgttgtgactgagaactgtgtggtgccggtgcaagtacctatgtctgagcattactaaaacgaatggaggcaatgatgagaaagttttttgcaatttttgcttggcttgagattattttaggcctagccatgctgtggatgacctttgatgttggattgcgagctacaggaccttttttcggcgccttaatcgtcttaattggcatcgtattgctatatggcttattgatctatgcgcttgtcgggtggtttattgatcggcaacattggccgtggtatgtggtaacactagtcgttaccttgatctataacgtgttagcgtggtctttccctaaaatcatggtgcaacgctgggctacgtatccttttccgatgttgacgctgatactcggttgtttgatggcgtggattgcttggcgtgagcagagcgtaacgcacaagtcggtgtagaaaccgggctggttcacgctttccaaaacgcgttcaccggcgcagtagtcttgcgtgtaagggtctcgaacgcaattggccaaagcccggccatcacgcccaaggccgcttacactccgatccctaggcgcgctggttcaggctttccaaaacgcgttcgcagtcgcagcaatctacgtgtaaggacctcaagcctcaatggccaaagcccagccattgaggcttgaggccacttacactccgattgctaagcgctcctgctcacgctctaaaaatgatgtttttcacgtttccctcaaagggttatactaaataaatgttggcatggagggaagcattttggcacgaacggtaaaagaaaaagaaaaatttgatatcacccggctgcggtttgtcttgctgggattgcttgtaggtttaatgaccggaacagttgtcagtgcgtttcgttattgtattgaagttggcttacgcgccagtcgtcaggtgtacggttatttgcgcgtaacaccgtttgtttggtggcattgggcgttgttaatcggctttaacctagtgcttgctggtattgttgcgtggctgcttaaaaaggaaccgtatatttctggctcagggatcccacaggtagaaggacaacttgccggtgagttggaaatgaattggtggtcgattctttggcgcaagtttgtcggcggggttttggcgcttgctcccggtttgtttcttggacgtgaagggccttcgattcagttaggtgcatcagtcgggcaaggcttggcaggcgggtttaaactgcgcggcactgatcgacggttgctgattgcatctggatcggctgctggtttggcggcggcgtttaatgcaccgattgccggtaccttgtttgtgctagaagaggtttatcataacttctcgccactggtttggctgactgccttggccggggcgattggttcggactttatttcgttaaatgtgtttggactagtgccggtcttgcatttgagttattcgcgcagtttaccggttacgagttactggcatttgattttattagggattttgttaggtttgctgggttatttgtatcagcgagtgttactagccatgccccgttggtatcagcgattgacacacttgccgcgtgcaatccaaggtgttgtcccatttgtgctcttaatggcggtcggttacttcacaccgaatcttcttggtggtggtaatagtttgattgttggttttggccaatatgtgccatcacttctggtgttattgggtatttttgtgattcgctttatcttttccatgatttcttacggttcagggttacccggcggtatttttctacctattttgtcactgggggcggtgattggcgcggtttatggcgtggtgatgaatcagctagggttattgccgcatgtttatatcatgaatttgattattttctcgatggccgggtactttgccggtatcgggaaggcgccgtttacggcaatcttgttagtaaccgagatggtgggcaacttaacgcatctcatgccccttgctgttttatcactgactgcgtatctggtggttgatctgcttggtggggcaccgatttatgaagccttgctggaacagatgacgattcctaaaaccgtcgctcaactgcaccggcctgatcgtttggaaattccggtattcgttggtagttcgttaaatggcaaactggttcgtgacatgccttggccaaaagaagccttgctcatcggcattcggcgtggcgagcgtgaagttattcctcatggggacacgttgatccgtgaaggcgatacattggtattgttgacggatgaggcacaacgagcacgagtaaagcgccgaatagatgctttttcagcagccttggcaaccgcgcataagtctgaaccatagtcaattagggcggagctttttcaagttggtttagtcatttcaggcgtatacttgtacctagcaaagacgtaccgacttgcaatagaaaggttttgattagtatgaaaaaacttcgcattgtatatgcaattgtcagtattttcttaggcctgttttattcaatcggcggagaactaggtttgcttacgtcatctggtagtggcgttgcgagctttctggtgccatttttgttgggctttgttgctaattggggcatgattgcgttggtcattgcaggattaattgttgataagcagatgcgctggtggtatctggggtatccggctttgatgggaattaacattggcctgaacctgatattaccgttgcagcttgctgatcaggcgagttatttggctccttttcttgttgcgattattggcggatatatgttgtatcgaacggttaagcaacgtcctgatgccgcttaaatctttcgtcagtgtacatgattttgtcaggtttgaagtgtaaatggcggttaaaatatccggctgacggctataagaacaaaatcgggtaaaattcgcctttgccttgcttttatgctaaactactaaagtgagatttttcgcaagggaggcagcaacttgcaaagtttattgaccacattattagtgatcgattcggttttgatcgtgatcgcaactttaatgcaaccaagcaaacaacaggacgcgttaagcgcattgtccggtggagcaacagatctttttgggaagacgaaatcgcgcggttttgaagcgtttatggagaaagtcaccgtcgtactgggtgtcattttctttgggcttgccatcgcgctggtttatctggaagcccactaaaacaaagtctcctggaacattcaggagactttttttgcagagtacataaaatctgcagtatgctgacataaccatttaatttaagctctttatgtcgggcagggcaacaggcagttatcggttggcggtcttttaggattgcttactaatcgattgtcacgaaggatgattgatcatgattttccgcaaaccacaaccattcgaatatgaaggtaccgatactggcgtggtattgttacatgcatacacgggtagccccaatgatatgaattttatggcgcgggccttgcagcgagccggttatggggtttatgttccgcttttttccgggcatgggacagtggagccgttagatattttgacaaaaggcaacccggatatttggtgggcagaaagtagtgccgcggttgcgcatatgaccgcaaaatacgccaaggtgtatgtttttggcttatcactgggaggtattttcgcgatgaaggcgctagaaaccttgccagggattacagcaggcggtgttttttcatccccgattttgccgggcaaacatcacttagtaccgggttttttaaagtatgccaagtatatgaatcggttagcaggcaaatcagatgaaagcacacagattctggcatatttgccgggacagttggccgcaatcgatcagtttgccacgacggttgctgctgatttaaatttagtcaaacagccgacttttattggacaagccggtcaggatgaattagttgatggtcgattagcgtatcaattacgcgatgccttaatcaatgctgcacgcgttgattttcattggtatgatgatgccaagcatgtcattaccgttaactcggcccatcacgcattagaagaagacgtaatcgcatttatgcaacaagaaaacgagggatagcatgaccacagttggccatattcgtaatgaactattagcaacatttcgtaagaatccgaacattgattattcggttcaaacactcagtcgcgcacttaagttaagtgaaggcggcgattttaaagtactcgtccaggcgttaaacggtatggaaaatgataacctgattcacgccaatcacgaaggacgttatgcattgggcggcgcgcctaaagtcttgaccggcactttccgcggcaacgaaaaaggctttggcttcgtggcagttgagggcttggacaatgatgtttatgtaccggcgatgaacaccgattttgcgcttgatggcgataccgttgaagtgcggatcgttcgtgaagcccgtcccaatgatagtcgcggacctgaaggcgaaatcactaagattgtgcagcgcagtttaaccacactggttggtgaattcaaaccattttccgataaagatcgggctaagtctggatttatcggaatggtggttagtcatgaaaagaaactgaagaattttccggtttatgttaaagataccggtaatattccgcaactcggcgatatgacggtgacggagattactgaatttccaaccgaatatcatcccaagttgatgtatgggatcgttgtcgagacgttaggcaacaagaatgatcctggcgttgatattatgtcactggtcatgcaaaaccatatcaaaacggaatttccggatgaagtgatggatcagaccaatgccattcccgatcatgttacgccagaagaacgagttggtcgcaaagatattaccgatcaggctgttgtcacgattgacggggatgacagtaaagactttgacgatgccgtggtggtttggaaattaccaaatggaaacttccatcttggggttcacattgccgatgtttcgcattatgtgacggaaggctctgcgttggatcaagaagcatttgatcgtggtaccagtacgtacttggttgatcgcgtcattccaatgctgccatttcgactatccaatggcatttgttcgttaaatccaggcgtggatcgattggcaatgtcgtgtgatatggaaatcgatcatgatggtcatgtcgtaaaccacgagatttatcaaagtgtgatcaagagtcatgcccggatgacctacaacaatgtgaataaaatcgtgaccgattacgacccggaagtcatggccgaatatcaagaactggtacccatgtttgaagacatggttgaattgcatcagatcttgtataaaatgcgtcatgctcgcggtgccattgattttgaagaaaacgaagccaaaatcattgtggatgatatgggtcatccaactgacattgtgttgcgcgaacgcggcgtttcagaacgcatgattgaatccttcatgttggcagcaaatgaaaccgtggctgagcactacaacaagcagcatttaccatttctctatcgagtacatgaaaccccggatgcagatcgcgtcaaggaattcatggagttcattgccagtttcgggatcacggtaccgatgaaaaagggtaaagagatcactcctaaacaactgcaagatgttgtgaccgatgtaactggcacgccagaagaagccatggtcaatgttaaattattgcggagcttgaaacaggcccggtactcaccagatccgctggggcattttggcttagcggcaaaatactattgtcacttcacaagcccgatccggcgttaccctgacttggttgtgcaccgcttgattcgggattacgcgctggaaggcactaccgatgacgtgaagacgtcttggaataagaagctgcctgatattgcgacccaagcatcgatggccgaacgtcgcagcattgatgccgagcgtgccgttgatgacctgaagaaagctgaatacatggctgataaggttggcgaagaatttgatgccgttgtcagtggcgtcacgagcttcggtatgtttgtggcactgccaaatactgttgaaggcttggttcacatcacacgaatgagcgatgattactattcgtttgtcgaaagtcaaatggccttagtcggtgaacgtaccaagcggacttatcgaatcgggcaatcgttgcgggtgaaattagacaatgtggacatcgatcagcggcaagttgacttttcactgattccagacgaaaaaacgccaaccagcgatttaggcaagttggttaaaaaagatgatcgccgtgatcgacgctcaaatggcagtcgcccgagcttcggtaacaatggtcgtggtggcaatcgtaatcagcccaataatcaacgaccacataagccagcaggtgcgcctcatcaaggtaaacattataacgccaagcgcgggactaagtaacgctggcaacttttaaatatacgaggggatggttcaatggcgaagaaacatcgacaaaaacctgacaacctgctcgcccagaataaaaaggccggtcatgattacaacattcttgatacctatgaggctggtattgctttgacaggtaccgagattaaatctgtgcgcgatggcaagctcaatttgcgtgatggctttgcccgtattcgcaacaacgaggcttggcttgaaaatgtgcgtatcagtccttacaaagaaggcaatttgtttaacgttgatccgatgcgtaaccgtaaactgttgctgcataaaaaagaaattcgcaagctcggtcaaatgacggcgcgccaaggagttactttggttccgttgcggatgtatcttaaacacggttatgccaaagtgttgatcggcgttgcggaaggtaagcacaactatgataagcgcgaaaccttgaagcgtaaggatcaagagcgtgaggttcagcgggcattaaaagctcggtattaataaaatttgcgccagcatgaagcctgtttggcagatgagtgttggtgtaacacaaataggcattagcggtcagagatgacgctgatgcctatttattttgtcctgagcgtggcagcctcattcaatgatcaaggtcatcgggccctgacaccttgtatgatgccctatgatgaatcgccaatagacttttgtgattgtagcctaaatgacattaaacgatgatcagttaagcggagggtaaacacgctgatgcgaattgtttgagcgcctgatatgaaggcggtatgatcgctgtatagatactgttttttggcaggattttgttacttatgaagaaagaagggcggattatgaacttagctgctttgttgcatcgcccggaaagtgaagattgttttttatatacggatgaggcaatgcgtgtgcgatttcacacggcacgtgccgatgttgcgaaggtgacggttctgtatggcgatccttattggcaactgcctgatgcagatggcactaataagttgatttatcagcgccggtcgatgcatttgataggtcacgggcaaactagggatcactgggaggtgacactcgaagctccttatcaccgcctgcaatatttatttgaggttaccggccaagatggcgctgtgtggttgtatggtgatcgcggcgttcgagaaaatcacgcggcagcacgacataaggcggaaaactattttcggatgccgtattttcatgcaattgatcgggttaaaacgcctgattgggttaaacagacagtttggtaccagatttttccagaacgctttgccaacggggatcccgataatgatccgattggaaccaagccgtggcggccaacggatcatcccgggcgcgaggattattacggcggtgatttacaaggggtattggaccaccttgacgatttacaggcgcttggtatcaatgggctgtatttttgcccgattttcacggctgcttccaatcacaagtacgatacgattgattatttgaatgtggaccccgcgtttggcgataaacttttgttcgcgaaattgattcaggcggctcaccaacgcgggatgcgagtcatgcttgacgcggtgttcaatcatatgggctttggcagtatgcagtggcaagatgttttacgcaacggagaagcatcgcggtttgcgtcttggtttcacatctatcaaacaccagtcacaccgtttcacaatcctctcaagaatgccggccaaccgcagtatgatacctttgcatttgaagaaaagatgcctaaattgaacactgccaatcctgaagttcaagaatatttattaacagttgccacttactggatcaagatatttgatattgatgcgtggcggttagatgttgccaatgaagtcgatcatcatttctggaaaaggttttacgccacggtaaccgcgattaagccggacttttatgtgttaggtgaagtctggcatcgcgcgcagccatggttaaacggggatgaattttccggggtcatgaactatcccttcacgcagcagattgaggatcactttttcaagcgaacattgaccgctgaagaaatggtggcgctgttaaccgatcaactcatgtactatcgcgatcaaaccaatcaggtcatgttgaacatgctggattcgcatgatacaccgcgcatcctgacgctggcgcatggtgatgaagccctggcactgcaggcgttgacgtttacctttatgcagactggtgcgccatgcttgtattatggtaccgagatgggcatgtcgggtggcgatgatccggatgaccgcaagccgatggactggagcaaacttggcagcccgatttggaaaaaggtggtggagctggtacactttcgccgggaacacgcacagacattaggccaaggcagtacgaggatgtcggtgactgcggccggcctgataaaagtgacccgccatggcgatgaaatgttgacggcttactttaatacgcaggatcatggagcagccgttgatggcagtgctgttttggcgcaaggttttacgaatggcaagttgtcgccaaaaggatttatggtacaagtgggtaaccagtgaggagcatcagggtttgtgtatgaaacgagacctacctgtgcaaagggctacgtgccataacgcgcttaccggtacaggtttctactcgcgccagtaagcgtttattttcttttagtggggggattaaaagtgaagcgattattcgaagtcgatccttggttagtggcaacacatcgtttagagacgacagatcgccggctgcaagagagtatcaccgcggtaggcaatggttatatgggcctgcgcgggaattttgaggaaggctacagcggcgatggtttgcaggggacgtatttaggcggcgtctggtttccggataaaacgcgcgttggttggtggaagaacggttatcccgagtattttggcaaggtgattaatgcacctagttttctggggattgggataacggttaatggtcaacaggtggacttagccaaaagccattaccgcgacttttatctggcattggatctgcatcaagggctgttgacacggcggtttgtttatatcggcgctgatgtggaagttcagtttgagtttgcccgctttttaagccagacgataccagaggcggctttgatcaccgtgaatgcaaccgttttaaaaggaaccgccacgatcacttttgacgctaccttagatgggcgggtgacaaatgaagacagcaactatgatgagcggttttgggtggcgcagcatgaggatgcaacggctaaaagcattcaactgcaaacaaaaccgaatccatacgctgtcccgcagttcaccgtattacttaagcaacaattacgcgtgaatgggcaggcaattgtcggcaaagtcacaactgctagtgggtggcttcaggagcaggtcacaacgcatttaacaacaggcgagcactatcagctggaaaaagatgtggtggtcgtgacaagtcgtgatattgcccctgacgatcaagccacaaaagctacccagctgatgaaccgagtcgtcaaggatgatttcaagacccatttagcagctcacacgcaacgttgggctcagcgctgggctaaaagtgatgtcgtcattgatggtgatccggccgcgcagcaagggattcggtttaacatcgcgcaattatttatgacctactatggtgaagataaacgcctcaatatcgggccaaagggatttaccggtgaaaaatatggcggtgcgacttattgggacaccgaagcttttatcgtgccgatgtatttagccgtgaccccgccggaagtgacccgcgcgctgctgcagtatcggcatgatcagttaccgggtgcttatcacaatgcgcgtcagcaaggcttggccggcgcgttatatcccatggtgacgtttaacgggattgaatgtcacaacgaatgggagattacttttgaagaaattcatcgaaatgcggcgattgcatttgcaatttatcaatatacggcttataccggcgacgaaagctatgtgaaccacgatgggctcgaagtattggtcggcattgcccgcttttgggctgatcgggtgcactttagccagcacgcccaaaagtatatgattcacggggtcactggccctaatgagtacgaaaataacgtcaataacaattggtacaccaataccatggctgtgtgggagttgcagtatacgctggcacagttacctaaaggcgatcctgatattgtggcggcattggcagtaacagatcaggaaaagcggcattggcaggcgattattgaccagatgtattatcccactgacaagaaattgggaatttttgtgcaacaagacggctttttagataaggatatacggccggcaagtacgattccggaaacacagcgcccgattaatcagcattggtcatgggatcgaattttgcgttcaccgtttattaagcaggccgatgttttacaaggattgtattttttaaacgaccggttttcgcacgcggaaaaagaacggaattttgatttctatgagcccttaaccgtccatgaaagctcacttagtccgtccattcacgctattttggcggcggaacttggcaaaatggatacggccgttgccttgtatgcgcgtacggcccggctcgatctggatgattataatcacgatactcaagatgggttgcatattacatccatgagcgggagttggcttgcgattgttcaaggatttgccggtatgcgctatgaccatgaccgtttgcgctttcggccacaattgccgaaaaattggcagcggtatcaatttaagctgacttatcgtggtcggctgttagcagttgacgttggccaaaaagtaacggtcacattacttgctggcccgccgatcgatcttgatatcaatggcgaaacgcagcacttggaggtggaggatgaccatgcttaagggattcatttttgatttggatggggttttaaccgacacagccacttatcatctggccgcttggcacgaactggcgcagcgcctcggcattcacttgccagctgcagccgatacggcgttgcgcggccgctcgcggatggactcgctgaatctgatcctgcgttatggtcatcaagaaaatgactacgatgaggcacaaaaagccgccttagccgcagaaaagaatcagcgttaccaaacgttcattcaatcactgacgtctgcggatattttaccgggaataccatcactgttgaaaaatgccaagcagcaggggttaaaattggcgattgcctcggcgtccaaaaatgctccgttgattttacggcggttgggattattcgcgcaattcgatgcgattgtcgatccgcaaagtctacaccatggcaaaccggatccggaaatttatcgcgcggcgcaggaattgctgaagttgcaagccgacgaggtcattagttttgaagacgcaccggttggcatcgcggcgattaaagcagccggccagtttgcagtcggcatcggggaggcttcggcattggcggcggccgattatttggttagcaatacagcccagcttgattacgatcaaattgtcgcggcgtttgagcggtatcatgcgcggtaatcagcaacgtcacgctaagttgatacggatattgataggtcaaaaatcatgtgctgaaaagtaaaaacattttgacatttctttcgctggcgttatactaatcatgtcaaaaggatttgacatttaaggggtgagagccatgaagaaaatggatgaaatggagcggaattttgccgatcactcgataagaattgcttacatgatgatgtttctaatgttatggtcaagtgcggtttttcagcatattcgtacaggagcgtggaatttcgatttctttgtggttaacgtggtgacggttgttcaaattgccagctatgagtggttcaaacaccgagctgattcaactgacaaggagccgggacgagttttgtacatgaccatcgcaggggtggcgattgttcttgctgttggcgtgctcgccttgatgcgtcatggaaaataagattcgcacccttagaacccagcagcacctgacgcaacaggaattagctgatgcagtcaatgttacgcggcaaacgatcaatgccatcgaaaacaataagtatgatcccacgttgtccttagcatttgcgttagccaggcagttacagacaaccgttgatcatctctttcaaagttaaaagcaggctgtccacgtcaacaacgtgaatagcctgctttttagatagatcaatcatcatcttctccgagcgcatcgaagtcataataaagatcacgttcgggtaagacaacatctgcatttgtttccgcgtcaatcgcctcagcttcacgttccgggtgaaagctatgccacggcacgatcacccgggggttcacttctttagccaacgtgattaagtcttcgcgagttgcatggccggaagcattcataaactgcaaaggaatttgatggtccgccaaccaatccttcagctgagcaaaccgcggatcgtaatcccccaaaggttcaccgttactgtgtacataagcgctgattggtaagtctgccaaccgctcaaggtgcgcgtaactattttgcagaacatattgttgaggcgcctgtgcaaggtcagttaactggattgttttgccaagaatcgcatcaggctgctggttggtcattgcagttaaaattgccgcttcgttaggctcccacaccaactgacgcccacttgcatgcgctgaagcttggaaggctgccatccgctcataattgcgattgtaagggttgatgacgaccagctgtgggctgtcagttagcaattgccggaatttggtttgcaggctcatttcggtcagtggcacacttggatgatcctgatcttcaaccggtgtcggtgtatcaaacgaaaagctagtgccttcaagcatgaagagactgatcttttcagcattgaaacggctagcccaggcgtgcacacgatcagcatgcgggccattgaggcgaacgtccccggaatgggcaaagcggcgcgcaccatcatcaatcaacagcgccatcaccccgggttcatcgtgatcgctgtgaaatccggttactgtcaaatcgccaattgccagtggcgtttcaaaggctaaggaatggagattggcaaccggtttttcgatgcctaagcgaatgagcacctgatagaggcgataggatggttcagaaagatagatcggaatgtttttctgcaaatattgtaaggcacccatatgatcaatatgcaggtgcgagatgaagatggcttcattggtaaacgaatccggttgatcgaaaaaaagttccgggacatgcggtagtttgccgttatcaatggccgaggcaaccgtttcatggcttaaatcagctgcaaccccaaaatccatgatgacccggctggttttggtggcaaattcgacaatgttgccaccaatggtattgagaccgtttaaaaagcgaatcgtcgtcacaataatttcctccaatgtctctcgttggcattcgcgagaacattaaatcgtaccccggatatgcgtgaaaagcaactattaaagtgaacccgacggcgtcaactttttgtgggtttaacttgtaaactttttgctagaatgctttttcaacttacaactgatgtgtgataccgtattgccagccgcgatgtttcccactagcgagttctacaaacgctgcttgcgccgcttgtgagtatttcgtggctgctgatttaaactgaatcttaatacgatcatcaacgcgaatatcaatctttgtttggtgacgttccttggcttcggcttctaaccgctcaaaaacgtttccgcccttaagcacgtatacccgcgtctgtgataaattgtctgtgccagtttgtgaccagcccattggccgcgaactgaagcgctctgaaagcatatgactaatatgaccttcagctgatgtcccgtgaaagtctggatcattgttggcctgaatttgtttccaattcttgtgaatgagcgttcgtgcttgtcggacagctttgcgttctgacgaccgtaactgagggtcattgagccgaacacggaaataatcatttagatagcttgagtgcccttgtaacgcccaatgcatgagaatatcgcccagattaccgggtacgccaattgccgcttgtttgcacgctttacgtaggtgaaatttatcgtagaccaccgtgcagttgggtagaaaatcggccccggttttgatccaactggcaccatcaccggccagaaaaaagcgtttgggcatctgaccgccatattgtttcatgatgcaatcaagcgtggtttgccagatttcttcagtaccagctgttcccgggtattcaccggtaatataaaatggcctaatcaactgaaacttcttacccacagaccgataaccttcatgtacataaaccattttcaagaaatgattggtgccgtcctgatgggggacatgatcttcatcggcttcgacaaataatgtttccggtacgggcattggttgatcctttaactgatccaaagcgctgatggccttcccgtctctatgaacaacatgcatgacggtgctcttcgatggttttgtacccccgccgttacgatctcctgattgcttgtaagacatttgggcggcatcttccagcagcttagctttgaggtcgagcgaaagtcggctacgcttctcaataccaacgagttcatcaagcaagaagacacgctcgccagtccgtttatcttgataataacgtcgggtgaaaaccagtgagccaatggatgccaagtaagtgcgttcccgcttatctttgacgctatagaatcgacggcggtaagcactgtccataatagcttggtccacttgttccagtgcctgcccaactaactggcagaggtgctcacgaaagttttcctgattggttaaaatgaattgacttaaatccagcttgcccgcgaccatctccatgacagattcatcaatttctttcaacatttctaaaatgatttgttgtactataggtgacaagagcgaattcctcctactgctatcgtgtttttcttgcaattaacattctagcacgaagggattcgctccctttttgtttgctcagatatcacccacttaaactttacgccatggtgaacccggaaattaaaatcagcctcagagacagtttcgtctctggggctgattcagtgtcgtgctggtatgacaagtcataatttggcataccaacctagtagtttttggttatttgtttgtcttgataattgtttctgcctgactttgcagcgtcttcaaagcttggtctggtttttcgtgtttcgtcagcatagcatcaaccgcgttcagaagatcgttgcgatattccgagaagccgatgaaggcagtggattggaaaccgaagccgagtgaatcaacggctgctttgctggttggattatcactgagatatttcttgaagtcagctgattgaaccgcggatttacgcagcggaacataaccggttaattgtgcccacttggaagtttccttttcagatagcaggaacttcatgaatgcccaagcacctttttgctgatcagtagaagcggatttgaagaggacaatatcgttgccggccagttcagttgctttcttacccttgtaacttggtagtggcatggtgccccacttaaagtctttaggcgcattttgcttcatgttggtgatgccggcactggagcccgcgtagaagagcgttttgccggaagtgaagttcttatcgccataaatatcttcaccagcggttttagcctcgccgttgttcaccatatccatgatgaagttggctgcggttaaagtcttcttgctgtccaggtttgccttcagcgggttagcagaaacaagcggattgcctgcttggcgtgcaagtccttcgaattccatatcgaaactcttgtcaaagccaattgccgcaacgccgtcagccttgagcttctcggcatccttcttaatgtcttcccagctctttggcttatcgatgttgtacttcttcatcagtgcttcattataaaagagaatccgcgttgacttggagaatggcacgctatagtacttgccttggtacttggagctagacaagaaggctgggtagatatccttcaagtcgctattgctcattttgtcatcacctttaagcatgtattgatcaagcggggtgatgaaaccatttttcacataatcaggaacggtggtgtaggttgtctgcgcaattgtcgggagattacgcgactttgcggcagccataatcttttgctgcaacgcggtgtaattgccttgcgcagtgccgacaactttatactgcttttggctcttgttgaagtccgtgatgatctgattaagcgccttttgataaggaccgttcatcccatgccaaaaggtgatcgtcacacgtttacccgaatcgctcttagtcgtggaactggatttgctgctactgttgctgccgcatgcggttaagatggcaaccaacatgaccgtaaacattgcaagtaatgcttttacccaagtttgctttttcattttgatagattatcctttcaatccagctttagaaatcccagcaataatgtacttctgcaagaagatatacaaaataaccattggaatgatgacgaatgtggaagccgccatcaaaagttgatattgtgtgccggcatcagttgtgaaggcctgtaagccgactggcaaggtgcgcattttgtcggagtttgtgacgatcaaaggccacatgaatgcgttccatgacccgatcacctgaaggacggtaaccgctgtgatcgtggacttgctcattggaacgagcacctgccatagatacttccaatccgatgccccgtcgattttggcggcataataaatctgatccggcgtcgattggaaagtttgacgcaacgtgaagacggtaaagaagctggccagccacggaagaatcagcgctccgtagtggtcgatttgtcctaagtgcgacaaggtgacgaaattggggatgatcaacatttcaccaggaatcatcatggttcccaagaaaatgataaacagaatattcttgccatagaacttcaaccgtgaaaaagcgaaagcagcaagaatactggtgaaaagctgtccaaccgtggtcaccaccgttacgatgatactgttgatgaaatactgaccaaacggcgcttcattccatgccttaacatagttgctccactgcaaggcttttggaatccaaattggtggaacggcgattgtttccggtgcggttttcagtgatgtcgaaatcatccatagaaaggggatcagcatggtgatggcccctaaaatgacgatcagataaagtaagactttactgagcttttttgccatagtttgcttttcccccttaataatgaacgtgcttgcgcgaataccacagctgcacgagcgtcacgagcaagatgaggaagaaaagcacaacgccggatgcggccgcaatcggatacttatactcggtgtaaaatttctggtacaagtagtacacaatcgttaaatcggccttgcctggtcccggcgtcccttggaataaggcaaagatttcatcaaacactttgaaactgccgataatcccgttaacggaaaccaagaaagtgatcggtgaaagcatcggaatcgtgatgttccaaaatcgctgacgagcattggccccatcaatttcagcagcttcgtaataaccgtggtcgatgttgtttaagccaaccaggaaaaggatgatgttgaagcccaaacttttccagatactcatgatgatcagtgccaacaaggcgtagtgcggatcagtcaaccagttaatcggatgaagtccaaaccagctcatgaagtaattgatcaagccgtaattaccatggaacatccaattccagaccatcgcaatcgcaaccgtacttgtgacgaatggtaagaaatacacggttcggaaaaaaccggaaatgatctttacctgattaagcagcaaagcaatgattaatgacaaaacaaccgttatcgggacaaccccgatgacaaaaaccaaggtgttgcgcactgccaaatgaaaatcaggatcattccagagatagacaaaattgtcaaagccccagccgctgaccttatccgtgtaaaaatcatacttggtgtacagactcattaaaaaggaattaatgatcggccagatattgaaggtgatggtaatgacgagcattggcagtaaatagagtgctgctttagccgtcgatttgagcgtggctttttcattcagcatgactttcaccaccaaaaatcaaggcgccagactgatcaaagagaaaaaatcctgatttagtgatgtaaaaatccaactccggctgacgactggaaacgccagccatttcggtagacagaagccgctcgccgttataatcaatatcggcagtcgcctcacgtccatatttggaactatgcgtgatcttgccatggaacttggcaaggacattttcgccagcatcataagggataatggcttcactacgaatgccggcagtgacagcttgtttcaaaatcgcctctggtaccgcattagctaaatcagctgataatgcctgtgccgggatcgtgttaataacaggttcgccgataaacttagcaacgaacaggttgttaggctgatcgtagagggtctgtggcgaactaaactgctgaatggacccgtttgcaagcaccataatgttgtcggaaatatgcagggcttcgtcttgatcatgggtgacgaaaatggtggtgacgccggtttcacgttgaatccggcgaatttcttcacgcatctcgattcgtaaccgcgcgtcaaggttggacagtggttcgtcaagcagcaaaagacttggcgatttggctaacgcgcgcgcaatggcgactcgctgctgttgaccaccggataaagctcccggttttttgtcaagctggtcttcaacgtgcaccaatttggcaaggtctttagctttggcgtggcgctcggcttttccgactttagccatcttcagtggaaaggcaatattgtccaagaccgacaagtgcggatacagactgtagttctgaaataccatgccgactttacgggctaaggcatcttttttagtgacatccgtatcaccaaagaaaatttgcccggcagttggcgccaacagtcccgaaatcaaattcagtgtcgtggtcttaccgccgccggaaggacccagcagggaaaccagcgtgccatcgggaatggtaaaattcagatccttcagggtatctttcttgccatcgtaggacatcgtgacgtccttgaaagtaactttcaacccagtacgctccttcgaatagttttctgctcctcacctccgttcgtcggtcccacgcaaacatgccggtggggtcgcgccaaaaagaaaatttggaacaagatattgtggtgccgccacttcactaaagcatatctagggggcggggcgacaacacaactcttcacatattttaacccagtttcactcaaaattggactcattcgcttaaaaacatttgattgttacacaacaagcgataagacgcgaacgttcggcttctctgctataataaattcatgaaaaaggagcgatttttgtgatcatacgtccaagtaaaccagcagatgctgctcaggtggccccgctgatcgatattgtctttactgaaatggaaataccgcagttaatgcgggttccaaaaccaaccttatatgcagttttgcaacaagcatttctactgcccacttatcgttacggttatccacaaattctggtagccgatcaggatgggcatattgaagggattgcggttgggtatttgcacgaacaagaagcacatatcgatgatgctttacgtcctttgttgccaaaacttgggttaaccccgcaatcatctttgtttacggataccgaaacttatccaggcgaatggtatcttgacaccttagccgtggcggccactgcgcaaggacatggcattggaaccaagttattacaagcggttgatccggttgcccgcgcccgcaaagccgatgtggtcagtttgaacgtggataagcagaatccgcgggctaagaagttatatgaacgcaatggctttgtcaaaaatggcgagctgatgattggcagccatcgctacgatcatatgattcggccagttggtgattaagtgaaaagtcggcacttacagctggtagtggaaccaaacaaaacggcactcgcgatgggaaatcttttgcgagtgccgttttgtttttcttaccatacttaaggtatcgtccattttttgtatcattacagcagttaaagcctcagtcggggaagtccagaccatattcataacgtttcaacggatccgccaccccgacatggcggaagcggtcgaggatagccgccagcaaaatggcagcaggaatgtcccgattgctgggaatcgtaagcttaacaattgccggagcgacttcttcggcactaaaaatggttttgacgccatggaagacctgataatgattgttgagcaagttacccatggcgacccaattaagtttggagataaaaatgaattggtgccagacgccaaacatttttttgacactggcaacattacgatcggcaatatataagtcatagcgaggaaaaacgctgactgttttttgacgaatcgaaccgagcggattgccgcttagtgtgttcaaatcaaatccgccattgataataccgtggcgggccgtcaaaatatacgccggtttgccattgtcggttttcaccacactcagactgccggtacttaacgcattcatatcaagatataacgccatttgcagacctcccaggaaaggtcacatgctgtgtttaaccgcaaagattagaaatgggcatttgatgcttctgccttgttaacgcgaatagccttgcgaattgcggcggcaacgccattttcgctgttggttttggtggtatcccatgccaaagcagtgatttcaggaatcgcatttcccatcgcaacgccatacttggccattttaatcatgctagcatcgttgagattatcgccaatcgtcatgacttcatccatcgtgataccccgttgcttggcataagcttcaacggcataacccttttgtgctttaatattgttaacttcaatgttgttggccgaacttgaggtgacactgagtttgccggtggcttcaaaagtctttgcgggtgcttttaaaatatcatgccgttcaccggtaaacgcgatgaacttcataatctggatcgttggatcgtccaataattcttggtagttatcaacgtaattgatattcatcagttcaagtcgagcagccgccagtgccaccgcaagtttgtaagttgtatcaggattcagatcaacgagcagatcggcaacattttgaatccgctctacgcgactatctgagaagacgcctttgttggtgacaacttcaaagtaaatgttgtctttttgcagctttttgacaatataatcgtttagatcgtcagcaattggaattgtgaccacgagcttgccagcctcgtcaaaaaccattgcgccatttaacgtgatgaaggcgggttttaagttctgagctgccaataagggttttgcctcagtcacgccgcgtccggttgcaaccatgaattcgataccagcggcttgcgcttcacggatggcctgggcgttttcgtctgagacttccattttgtcattcaaaagggtgccatccatgtccgatgcaataagtttaatcatatttacagttccctccggtttgtcatggtgccgttacgattttaattttagcatgaaaaacgcttgcccggtagcaaacgtgctgggattcttgtacactatttgcggaggtgcagcttttgaaaacattaatccataatgattggcagacggttctggaaccgatttttgaaagttccgaatatgcacggctgcatggctttttaaaagaagagtatgccactaaaacgatctatcccgagatgcatcatatcttccaggccttcgaatggaccccgtttcatgatgttaaagtggtgattttaggccaggatccttaccacaatccgcatcaggcagtgggggctagttttgcggttgcgcctggcgttgccttgccaccatcactgcagaatatttataaagaattgcaaagcgacttagggtatccacctgtgcaccacggctatcttaaagcgtgggcgaatcaaggcgttttattgctcaatgcggtcctgaccgtgcaggctggacacgcgtattcgcatcagaatcacggctgggaagcattaaccgatgccgcgattgccgctttgtcagcgcgcggtggcgtcgtgttcattttatggggcaatgcggccaagaaaaaagccgccttgattgacacttctaaaaatgccatcattgcgtccgcacatccaagtcctttatcagcatcacgtggtttttttggtagtcggccgttttctcgcacgaatgaggcattagagaaaatgggagagacgccgattaattggcagctgccagagacggttacgacagaaaattaaaatgatagcaacagccgtttaagtggtgcaaaccagtgattcccatttgtctcagcgtggacagtggggtgttgaggaacaagcagccgatttttccttctgacttctgctggtcataacccaataaaaacggtatgatgatacagaataaagcgcttttatggagggataaagtttggacctatttgaaagcttaaaagataaaattaacggtaaacatttgcggattgtatttccggaaggcgaggatccgcgagttttaggcgctgcagttcggcttgcagctgatggcctggttcaggcaattgtcttaggtaacccggataagattcaaagcctggccgccgaaaaaagctgggatctgagtaaattaaccgtacgcgatcctgaacatgacgagctccatgaccaaatggtgacggcgtttgtcgagcggcgtaaaggtaaggcgacccaagaacaagccgaaaagattgttcagaatgccaattattttgggaccatgctcgtttacatgaagaaagctgacgggatggtctccggtgcggtccattcaacggctgacacggtgcgcccggcgttacagatcattaaaacgcggcctggggttcatttagtgagtggtgctttcatcatgcaacgcggtcgggatgaacgatacttatttgccgataacgcgattaacatcgatccggatgctgaccaattggctgagattgcgattgaatcggctaaaactgccgcattgtttgatatcgaaccaccacgcgtggctttgttatcattctcgaccaaaggcagtgctaagggaccgcaagtggataaagtggttgaagcaaccaaaaaggcgcatgaattggcaccggatttggctttggatggcgaattacagtttgatgctgcctttgttccaaccgttgccaagcaaaaggctcctgattccaaggtagccggggaagctaacgtctttattttcccggaactgcaatcaggtaacattggctacaaaattgcccagcgattcggcggttttgaagcgattgggccaattcttcagggactgaatcaaccggtttccgatttaagccgtggtgcaaatgaagaagacgtctataaactggccattatcacggcggcccagaccttgctatgacaagcttaaagaaagatttcaccagtgaagctgcactgcaggcctttgctgcttcactgggaccgcatctgcaagcaggcgatgtgttactgttggacggtgatcttggcgctggcaagactagttttaccaaaggcttggctaaggggttgggcattacggattatgtcaaaagcccgactttcacgatcattcgtgaatatcgccatggtcgcctgccgctttatcatatggatctttatcgtttggaagatggtggcgccgaggatttagggttggaagaatatttcgaaggtgacggcgtttcggttgtcgagtggcctgactttctggggcttagtgaaccggaaaccgatctgctgattcattttcaaaaggatgataattcggataccacacgtcacttagaactggttccccgtggtccgcgttatgaggcgttacttcaaagcctcagctaatgtgttaatgatggtttgctagagaacattcggaaaaacaggatcgagcatgatcgcaagtcgaaaaagcgatgcccggtgctgtttttttgtttgaatcagccgagtaattgtctagctgaacgctcatattttgataactaaagtttgcatgctaaactaatagcaatgtgagctgttgaacgaataggaaggtaggtgcaaaatgttagaaatcaaggatctggtcaagactttcggtaccatgaccgccgttgatcatgtgagcttcacggtaaaacccggtgagatcatgggattgatcggacaaaatggcgcaggtaaaactacgacttttcgaatgattctgaatttcctgacgcctgattctggcaccattagttggaacgggcaaccactgacggccaaagattacgatatcattggctatttgccggaagaacgcgggttatatcctaaaatgcgggtgcaggatcaaattgtttattttgcccggttgcggggtatgaaaacagctgaaatcaaagcgaggattccggaatggctggaacggtttcaggttaaaggtaaggctacggataagatcaaggatttaagcaaaggcaatcagcaaaaagttcaagtgatcgcgacaatgatacatatgccaaagctggtcattcttgacgaaccgttttccggactcgacccggttaatgccagtttgttaatggccggcatcgagatgcttaaagacaacggcgcagcgattatctattccagccacgatatggccaatgttgaagccatttcggatcatttggtgatgcttaaacaagggcgtatggtcttgaatggtgccgtaaatgccattcgggaaagctttggccgcacaaaactgtttattgaatctggcttgtcggaagcggaattacaagcatttgacggggtgacacgtcttcgtcagcacggacaggagtttgagttgacactggcggatcccgcagtaggacggcaaatttttgccaaagcggtagcaaatggctacataccggaatttcgccaacaaccgcctacccttgatgaaattttccgcctgaaagtaggtgaatcaaatgcataagttttgggtcgtcatgagtcaggtttacaaaaagaacgtcaaaagtggttcgtggattttcctagtgttgtcgccattgctttttctggcaattggggtcggcattgcgttttatgtagccaaaacacaagcacctgcccaagtggccgttgtcagtgacgttagcgccgtgggtcaggcattaagcaaacaaagtaccgatgacttaaagtttaaggtttattcgtcagataaaaaagccaatgctgctttaaatgatgagaagattgacggcgttttaacggtgaaggccgctgaccatttccgttcccattatgtagcgcgcgataacgggcaaacggttgacacgtcgacccttgtcaccgcactgagcggccttaagctcagcagtaccgctgccagcatgcacttgacgcctgcacaagttaccgccttaacgcaaccgcctgtggttacctcaaaaacagtcgcgattgaagatggcaagcaagtacccaaatcagactccacgcaactcatgaaccatggtgttgccgttgtgtcgatggtgctgattctgatggtgacgatggtttacggctccattctcgcgcaggaaatcgcgacggaaaaaggctcccggattatggagatccttttatcatccgtcagtgccacgactcagttcttcggtaaactggccgggatcttcgccttgttgttgacgcagctggcaatttatcttgttgccggattgattggttggcaattccttaaaaaccaaagcatggtcgcaggggtcttgaaacagtttgatttctcgattctattttccgggactactggcatgatcgcgatcttctttgttattggaacactaacattttcggtgttagctgccttgacgggttcgctggtttccaatcaggagcaggtgcaacaagctgctatgccgattagcatgctgggtttagttggctacttcattaccattgccgcgcagtcaggtgattcaatgcttgctcaaatagccagttatgtgccgtttttaaatgtcttcgtgatgccgacgcaaatgtcactgggacgagcaagtatgggcgaagcgtggatcagtattgcaattagcatcgccttcttggccttatttacaatgttcacggtcaaagtctatcgcaacaatgtgttggtttactcaggctccggcttgtggcagtcgatgaagacatcctttagcatctggaagtcagagcggcatgtcgtaaaaagataagctgaaaaagaaattgtgaacgcttgactgaacgggtaaataaaaatggctggcaaagatgcatttcaacatttgacgagcagcgtgctgtttacaatttgaaaataaaaacgagtgcaatttttcgtgttaagctgcagcgaaaattgcactcgttttttagttttatgcgctaatttgttaatcgtcagcctgctttagctaatttcatcatggctttagtccgcgcctcaccaaaatgttcattttcggcaatgaggattcttgcgcaggcataactgtccgctaaggcgttgtgatggtgctcaagcggaatcttgagtgcagcactgactgtatccaaacgatgattcggtaactttggtaaaaactgccgtgatgttttaaccgtatcaatgacctgatagcgtggcgcggcaatgccatagcgatcaagtgtcaagcgcaatacggaaacgtcaaacggtgcgttgtgggcggtgacaatccgaccaggcgtataaaacatttgaatatgcggccaaacccgatcaaaagtcggctggtcttgaaccatatcaggtgtaatcccgtgaatccgaatgttttgcgggtcaaattgcatctgcgggttgatcagtgtgtaaaaactgtcaacaactcgattttgttgcacgacgactaaggcaagcgagcaagccgaagcccgtttgcgatttgccgtttcaaaatccatcgcaataaaatccatgtcatcttctcctaaactaagtcctgagtcaccaattcgacgggacagtgatcgctgcccataatttgcgttaaaatcttagcatcctgaatgtaaggttgaaaggctgagctggcgacaaaataatcaatccgccagccggcattgttagctcgcgcgtggaagcgataactccaccaggaatatgtgaccgtatccgggtaaaaatggcggaacgtgtcaatgaagccactattgagctgtttggtaaaatcagcacgctcttcatcggtaaagccggcgttgtggtgattggttttgtcatttttcaggtcgatgggttcatgggcaacatttaaatcgccacagtaaacgagtggtttctttgctgccagttcattcgtgtacgcgagaaaatcccgatcccactgctggcgataatcgagtcgtttgagctcgccaccggaattaggcgtatagaccgtcattaaataaaacttggtatattcaagcgtaatgatccgcccttcggtatcatgttcagggatgcccatgccatacgtgacattcagcggcttgtgcttagtaaaaatggcggttcccgaataacctttacgttcggcataattaaaatattgatagtagccgggcaaatcgagttctacctgaccagcctgcatcttcgtttcctgaagacaaaaccaatctgcatccaattcgttaaaaatcgtcataaagtctttttttaaaactgctcgtaagccgtttacattccatgaaatcattttcaacatgcttcactcctatcgctgctatgcgccttcattttactagactttacgggtgaatgcgactggtgctcataggtcatggcgtaaagtttaagtgggtgatatctgagcaaacaaaaagggagcgaatcccttcgtgctagaatgttaattgcaagaaaaacacgatagcagtaggaggaattcgctcttgtcacctatagtacaacaaatcattttagaaatgttgaaagaaattgatgaatctgtcatggagatggtcgcgggcaagctggatttaagtcaattcattttaaccaatcaggaaaactttcgtgagcacctctgccagttagttgggcaggcactggaacaagtggaccaagctattatggacagtgcttaccgccgtcgattctatagcgtcaaagataagcgggaacgcacttacttggcatccattggctcactggttttcacccgacgttattatcaagataaacggactggcgagcgtgtcttcttgcttgatgaactcgttggtattgagaagcgtagccgactttcgctcgacctcaaagctaagctgctggaagatgccgcccaaatgtcttacaagcaatcaggagatcgtaacggcgggggtacaaaaccatcgaagagcaccgtcatgcatgttgttcatagagacgggaaggccatcagcgctttggatcagttaaaggatcaaccaatgcccgtaccggaaacattatttgtcgaagccgatgaagatcatgtcccccatcaggacggcaccaatcatttcttgaaaatggtttatgtacatgaaggttatcggtctgtgggtaagaagtttcagttgattaggccattttatattaccggtgaatacccgggaacagctggtactgaagaaatctggcaaaccacgcttgattgcatcatgaaacaatatggcggtcagatgcccaaacgcttttttctggccggtgatggtgccagttggatcaaaaccggggccgattttctacccaactgcacggtggtctacgataaatttcacctacgtaaagcgtgcaaacaagcggcaattggcgtacccggtaatctgggcgatattctcatgcattgggcgttacaagggcactcaagctatctaaatgattatttccgtgttcggctcaatgaccctcagttacggtcgtcagaacgcaaagctgtccgacaagcacgaacgctcattcacaagaattggaaacaaattcaggccaacaatgatccagactttcacgggacatcagctgaaggtcatattagtcatatgctttcagagcgcttcagttcgcggccaatgggctggtcacaaactggcacagacaatttatcacagacgcgggtatacgtgcttaagggcggaaacgtttttgagcggttagaagccgaagccaaggaacgtcaccaaacaaagattgatattcgcgttgatgatcgtattaagattcagtttaaatcagcagccacgaaatactcacaagcggcgcaagcagcgtttgtagaactcgctagtgggaaacatcgcggctggcaatacggtatcacacatcagttgtaagttgaaaaagcattctagcaaaaagtttacaagttaaacccacaaaaagttgacgccgtcctcataggtcgttctgtgttcatgcgcccgaatttctgctaaaatagtaagtagtctttttgaaaggacctgatgttgtggtagacgcaccacggatacttgaaggtatcaccatgttgcatgatgagccgttgagtcattatacctttacaaaaaccggtgggccggctgatttgcttgcgtttcctaaagacgtggctgaagttcaggctttggttgaaatggctcgggagcgggatatgccgttaacggtcatcggcaacgccagcaatttaattgtgcgtgatggcggcattcgggggttagtcttgattttaacggcgatgaaaaaaatcaccgtgaatggtaacgatgtaacggctcaggcgggggcccggctgattgacacaaccgaagccgcttaccgggccggattaaccggacttgagtttgcggccgggattcccggcagtgtcggtggcgcgttattcatgaacgcgggcgcttataacggtgaagtctgcagtgtgatcagtcaggcttacgttttgacgcgcgcaggggaactcaaaacttacaatcatcgtgaattaaactttcgctatcggcatagtgtggttcaagataccggtgacattgtcttgagtgtcaccttttccatgaagtttggcgataagcctactattcgggccaagatggatgaactcaatgcaagacgggcagctaaacagccactggagtatccatcatgtggctcggtgtttaaacgtcccccggatcattttgttggtccgatgattcaaaaagccggtttgcaagggcatatcattggcggtgcgcaggtatcgaaaaaacatgccgggtttatcattaatttaggcaatgcaacggcaaccgattatcttgatatgatccaccttattcaaaaaacggttaaagccaagtttgacgttgacctagagcctgaagttcggatcattggcgaaccgttacactaagcaatatcttaaaatctatttgaaaggggctacacaatgcatttagtcgaagccgtcttattcttgatggcattggtcatcatctcaaacgtgctcagtcattacattgtggctgtcccggtttctttgattcaagtcgcgctgggactaggcgcggctttattttttcatttaacgatcaatttagcgactgattggtttatgttgcttttcattgccccgctgctgttttacgatggtcggcattttccgcggcgagaactatgggagttgcgtggtccgattatggggaacgccatttttctggtgtttgcaacgatgctggtcggaggttacttaattcatttcctgattccgccattaccgttaccagcgagttttgcgttggcagccatccttagtcctaccgatccgattgcggtacagagtttggctaagcgtgtgcatttgccaagcggggttttgcacttggtgagtggcgaaagtctgatcaacgatgccagtggcttgattgggtttaagtatggcatcgcggccaccatgaccggagcatttgcacttggccatgctgttcgggactttttctatgtggcgttagtaggggcgttagctggcttggtgctaatcggcttgattaatttgagtcgcaactggcttttgcaacaagggatcaatgatgtcattttgcatacgattttgcaggtgttgacaccgtttttcatttatttgattgtggatgaatttatgcatgcttctggcgtcattgctgtcgtagtagccggtttactgagcaatacgcagcataatcggtatgtcgctgcgttgccggagttgcggattgtttctgaacggacgtgggatttaattgtttataccctgaatgggattatttttcttatcttagggattgagcttcctgttgccatgcgggacacaatagccgatcatgaagtcaacacatggcaagctcttgaatttgttgtgattgtttatctcggcattttggttttgcggacgttatggatttatggctacatgtggcttacggttcgttcaaaaggcaatcctccttcttggcgggcggcgttgttaagcggtatttcgggtgtccgcggtgctattacgctagtcggtgtgtttgctgttcccgcggcattggcaaatggccagccgtttcccgagcgcagtctgatgctgtttattgctgccggcgttgtcgtcttgagcttaatcgtggcgattgtagccttgccgctggtgacgcgctcagtcgcaccgttgcaaacccgtggctccacgattgccgcagatggtagcagcgatgtcgccgaggatgatgaaaatagtcacgatgttcgcattatctctcagcgtcaagctcagctgtttgtctatcaaatggcagttcgtcgcgttgaatccgagcggcgggagtcaaatcaaaaagcggcacttgatctgatcgccgaatatcaaaacctgattcggcgcctggagctagccgaggataccggcgccgccattccgccattggttcaagatgagcttgatttacgtaaggtgggggtccaaggcgagttatatgcgttagatgacttatggcgcgagaacaaaatcatgtccaaaagttatgccaaagctcacaaacaactgcagcatcgtctggatgatttgaattcaatggcgaaacgctccggccgaccaacattgcgcatgcttcttgaccggtccgcgttgaagctatcccacttttggtacacggttgcgagtgaacagaatcgctcgcatcgctttttcaatgagaaactgtttattgaaaaggaaacggcaaaaggcggcttgaagtatttgtcccaatttctacgccaaaaagaaaacaaggcccatcattacaaccgtcaagtgatttattcgttgattgttcagtaccgcaatcgaattgcatcggttaaagcattgaacacccacaaatcaacgcaatatgaacatgaactcggccgattacgcgcgattgcgtttgcagtcgagcgaacggctattcacgacctacttgaaaaagggtatatcaccatggccatggcccagcgcttaaatcaaaatgttaacttcgcggaaaatgctgcaactttaacttcgatggaagaagtttaggaactgggattaaaaaatagctcgacaaacaaacggcgaccagatgttctcaaatgagcatgtgcgggcgccgttttgttgtatcaaagggcatttaagctgccgtgaaatttttttttgaaaatcagctataaaagcttgcgttggtgcgtgacgttcgtataataggcagagttagtaaacttaaagtttagtttaacgaaacttataaaggcggtgtgccatggacattggcagtaaaattcgtgatttgcgcattcgcaaaaacctgacccaagaagagttaggggaacgaactgatttatcaaagggttatatttcgcaagttgaacatgatcaaagttcgccgtcactggaaaccttttttgatattttaagcgttttaggtgagtcgccagccgattttttccgtgaagaaccagttgattcactggtctatcatgcttcggatcaggtgacttatcttgatgaggacaaaggttatcaattgaagtggttagttccggagagtaatgaaaacgagatggagccggtgatgattgattttgcaccggatgggatttttaaaactttcgaaccatcaccggcggaaacgtttgtgtatgtggttagcggcaaagtgaagttgttgctgggtgaacagacttatgtcgctaaaaaaggggaaactatttatttccacgcaacgaaacaacatcaactggtgaacgccgcaacgggtcgcagcaaatgcctgctggttgcgacggcatcttatctataaggagttggggtcattgagcaatatcattgttgaactgaagcatgtcggaaaacgttatggcgacacgcaggtattaaaagatgtcaatatcgaaattgaacaaggcaagttctacacattacttggtccgtccgggtctggtaagacgacgattctgcgcgccattgccgggtttctggatgtttcggaaggcgaagtgctttttgatggcaaacggattaatgatgtaccggcaaatcagcgcaaggttaatacggtattccaagattatgcgttattcccgcatcttaatgtttttgacaatgttgcgtttggattacgtctgcatcggatgagcaaggaaacgattaagaccaaggtgacagacgcgcttaaaatggttcggttgcaaggctatgctgaccgggaaatctctgaattgtctggcggccagcagcagcgggtagccatcgcccgcgccattgtgctggagccacaagtgttattgttggatgaaccattatcggcactggacgcaaagttacgtaaagatatgcagtatgagctgcgcgagttacaagaacggctcgggattacctttttgtttgtgacccatgatcaagaagaagcattggcactgtcagatgaaatttttgtcatgaatgatggtcaggttcagcaaagtggcaccccggttgatatttacgatgaaccggtgaatcactttgttgcggatttcattggtgaaagtaatatcattcaggggcatatgattaaagatttcctggtcgaatttaacggtaagcaatttgaatgtgccgatgcagggatgcggccgaatgaaccggtcgaagtggttttacggccagaagatcttgatatcaccgcagccgatgccggcaaagtgaacgttgaagtcgatacccaattattccgcggcgattattatgaaattgttgcttacgatcagcttaagaatgagtggttgattcattcgaccaatccggcaaaagacggcgagacggtggggttgacgtttgatcctgaagacattcacgttatgcggctaaacgaatccgaagaagaattcgatgcgcggctggaaacttatgaaggcgattaagcacagtattgacagcgactttactgtgaccgtgtccgttaacgcacggtttcggctaagcaccgtttgatttctaatctgaggagggtcatcgtgaaaaaatccaccacgaatgtagcattttacacgccttacgtgatgtggctcgcgttgtttgtgatcgcgccaatggtgttgatcgtttatcaaagtttctttgatattagcggccattttaccttggcaaattatcagacttattttcagtccggcacttatattatgatgacgattaattcagtctggtatgcctttttaatcacacttgcaacattgctaatcagctatccgaccgcttactttctgcattatgccaagcacaagcagctatggttgctgctgattattctgccaacctggattaacttgttgcttaaagcatatgcgtttattggcatttttagtcaggatggcggcgtgaatagtttcttgggcatgttcggaattgccccgcagcaatttttgtttactgatttcagctttatctttgtcgccgcttatattgaaattccgtttatgattttaccgattttcaatgcgattgaagaattacctgaaaatttggtcaatgcctcacgtgatttgggtgccaaaggctggcagacatttaccaaagttgtctggccactgaccatttccggcgttaaatcgggcgttcaggcagtgttcatccctagcttgagcctgttcatgttaacgcgcttgatcggcgggaaccgggtgatcacactagggaccgcgattgaagagcattttctcaccaccatgaactgggggatgggttccacaatcggcgtggtcttgattgtggccatgtttgtgattatgttcctaaccggtgaacgaaagaagaagggggtccgccgtcatgaagcgtaagtttaagtggtccaacctttatctgattttcgtcttcatctgtttatatgttccgattttttatctggtcatttattcattttcaaccggcgatcgtatgagtaactattccgggtttacctggaaacactatgccgaactttttgcggatacccggatgattcaaatcgttttggatacactgcttgtggcgttactatccagcctgatcgccacgattatcggggcattaggtgcgcttgcgattgatcgtaccagtcggccggtggttaaaaatacggtgctgtcattgaacaatattttaatggtcagtccggatgtcatcattggggccagtttcttaatcttttataccgcgttaaaagtgccgctgggtttctggtcggtactgatgagccatattgccttttccattccgattgtggtgttgatgattttaccgcggctacaggaaatgagccattccatgcttgatgctgcgcgtgatttgggtgcttcaaactatcaggtgctgacgcgggtcattgtgccatatatcacaccgggaattttctcgggtttcttcatggccttcacctattcgctggatgattttgccgtaaccttctttgtgaccggtaacggctttgaaacgctagcggtggaaatctatgcccgggcacgtcagggaattagcttggaaatcaacgcattatctggcgtgatgttcgtctttgctttgctgctggtggtggggtactactttatccaacaagcgggacagagcaggcgggcaaaacacaagcgagaaagcgaggcgttactcaatgaaacgactcattagtattgcggttgcgatcctggcagtctgtctcggattagctgtttggagcgagaacttacaaaaatcgcaaggagataccggtgacaatacactgaatctttttaattggggcgattatattgatccggccttgatcagtaaatttgaaaagcaaactggctatcatgtcaatcaagagacctttgattccaacgaagcgatgtttaccaagattcaacagggcggcaccagctatgacctgactgttccttcagattatatgatcgagaaaatgaagaaggccaatttgctattaccgctggataaaagtaaattacgcggcatgcagcatatggacccgcgtttaattaataaagaattcgatccaaacaacaagtacagcattccgtatttctggggcacactgggcattatttataatgacaagtttgtcaatgccagtgaggtccaacactggaaccaattgtggaatccgaagtttaaagattcgattatgttgatcgactcagcccgtgacgtttttgcgccagccttaatctcgctaggcaaatcggtcaacgaaactaatccgcagacgcttgctgttgccaaagccaaactcgatcagttatcacccaacgtcaaagctgtcgttgcggatgaaatcaagatgtacatggcagaaaatgaagctaaaattgccgtcgactggtcaggtgaagccagcgaaatgttggctaataataaacacctgcactatgtcgttcctcaagaaggcagcaatctctggtttgataaccttgtcattcctaagacggccaagcatttcaaagcgatctatgcctttctcaacttcatgatggagccaaagaacgccgctcaaaatgcagaatacgtgggttacgccacaccaaatgcaacggctaaaaagctattgcctaaaagtgttcaaaacgatcgccaattctaccctgatgacgaaactatgaaacatcttgagatctattccgatctgccacctgccaaagttggtctatacaatgatttattcttagaatttaagatgtaccgccgctgagggttttggtaccattcagtccgccacggttagcttaaaaggctgacttggcgggcttttttgtttggagcttttggctgctttaaaaaccttcgaaacgatgctttatatttttggacaacaaaaatagccctcaaaatcttaacgcttatggtggagaataagcattgacaggaagattttccgagggccgattattgcgtctaaatgttacttcacgttataggttttggtgccaatagtttggaaactggcattttcaaacgtaacagtcactggattatcattttttagttcataaataaagacaccttgaacagttttacctggtagtaagttattatgcatagcgttctcttgcgcttcgaaaggatttgagccatcgtcattcattttaggcattccgctggttaagtcgacatttgaagtgtcgtttttttgtttaacattcatcgataccattccagccattggcatctgttctttcttggaagtgtttgtaacgtccacaaataagacaagattcttctttccttgctcgtaggcatcctggacttctgctttagtgaacttgaaggtcatatttgctgtgacccaagtatcattcttaaaagaccaaccactttttggggtagaggttttgttttctgccttttctgctttttcagcagtggaagttttcgaggctgacgagttatccttacttgctgaactggaactactgcaaccggctaaaaaaaatattgataaggttgcgactgtcactaaaatcagttttttcattttctcctcctaggactatcatgctgactaagcaaccttgttttgcttgcgtggatgttgcaaaaacaggaacacaatagcaataattaatagaacaatagcaggaaacgcaaatacagcagaaatgccaaagcagagtgatccaatgactcccaggattccgccgacaagtgaaatatggtgtttgtagctctgccatagtgcaacagcgtttagaactacgccaatccacgcaactgtgtaaaagaaaatgcctgcgccagatgtgacattggttttattggccgcgtcattaacggcagttgcaaagataacaaaccaagatgatgcgaagataaagcaggcaacaatgtcgtaaatggcagtccaaatattaatctttatcttgcccataaaaatccaacccctttacaaaaagcttttgtatcataacgacacttaaataggatcaacaccaaagccttgtgtgataatacttagatacaacaattaggtttattttgatttgggatatcacttctttcataaatgccaacgtttcatgtaaatagtgcaatgggatttttattagttcgtaatttcccaataccgttttaaatttaaggcagtgagatagattaatgcaaactttacgcttgggcgtgcttattcggtttttttaaaagagtagtacaagcagctgcaatcgggtaccatagtgatgaggtgatcgcgatgaagaagcatagtcggcatagtgaaggcgtgtggctggatatcgtttgttgtatcagtctatggctggcggttggaagtttggtggccgcagcgacggtgattcatattaatcggccatatatcattattgtgttggcattagctttttgtgcgattggcgaaacggtggcggtttttaaaaattggtgattggccagaatgatctgcatcagctaggtaagttctggatatgcacccgctttcattttcgcgacgagtgtagcataagtttatttcgtttatcaaaagatatgcatggtaatttggctttaaaaattaaaagtgacactaaaaaatggcctcggaaagttcaaattccaaggccattttcttagtgttgcttattcgacacgctttaccttcgcatgggctaagcgccgacgattgagccatttccgtccttcttcgattaagaagagtggaatcgggatgatggctaggaagatccaatcggtgagggctagtgggcccgtgtggaagagttcctgtaagaacggggtgtaactgagtagggccagcaggaaaatttcaaagataatgccgaaccagacaagtcgattggcaaacaaaccgactttgaagactgaggcattttccgtgcggcaattcatggctgcagcaatttgacagaagataatcgcagctaaggtcatggtagtcgccatgacataagttgaaccgcttgtggctaaaccgtgtgtcggccagccgtccagatgattgacgaagaagtaagcgccgctagagatgattgaagcaatcagaccgtaccacgcgaaggctttccacaagacggttcggctcatcaggtgagcattacgtgcgcgcggtggtttgtccataatcccgggctcggctttttcagatcccagtcccaaagcaggcatcatgtcggttccgaggtcaacggttaagatttgcatcacggttaacggtaggggaatagcgccacgtgagaagaggaaaagcgcagatggcacagcttcaggcaggttagagttcaaaatataaatcaggaacttttgaatgttgctgtaaacagttcggccttcttcaatcgccgcaacgatagaagcaaaattgtcgtccgtgagaatcatatcggctgcatctttggcgacgtctgttcctgtcacgcccattgccacgccaatatcggcttttttcaaagcgggtgcatcattgacgccatcaccggtggaagcaacaatttcacccatttcttgaagggttgagacaattttatatttttgttccggtgctacccgcgcaaaaatgatttcaccagcaagcgcttgtttgaggtcggctttactcatagcatccagttcggtgccggtgacgacgcgggctttatcagaggttaagccgattttgaccgcgatggatttagcagtcaacgatgaatcgccggtgaccataataatcttgatactggcgttatgacactttttgatagccgcgtaaatctctggccgtggcggatcggacataatcgcaaggccaacgaatgtgagcttggtttcagccgtttcaatcgtcagaccatcgagctgtttttctttgtcagctgcttgcgggatttcgcgatatgccgtggcaattgaccgcaaacctaaagctgcatatttacggttggccgcatcgatggcatctttgtcagcttgcgttagcggtcggactttaccattttcttgaatggtatcgcaatgtggtaataaatcgcttaatgagcctttggtacagatggagagcgtctggggatcgtgttggtggatggtggtcatgcgctttcgatccgagtcgaacggcaattctttgagtcgcgggaacttctgggtgtaggcgttcgtatcgatgcctgatttttgcgccaaaatgaccagcgaggcttcggttggagtgccgagaattttcggtcgtgctttgccttttgccggttcgacttcagtatcattattaaacgcgaccagtcggatgagtaaatccaggtccggatcgctgccatagtgaatcggttgaccgtttagctggatctcgccgttgttgacatagccttggccagtgacggtataagtgtgcgccggcgtccagacgtgatcaactgtcatctgattctgtgttagggtgccggttttatccgagcagataacggtggtttcaccaagcgtttcgacactgtttagatctttgagtaaggcgtgtttttttgccatccgctgaacgccttgtgccagcgacaacgtgacagtcggtaaaagcccttccggaataaacgcaacgatcatgcctagcgcaaaaataaagctttgcgcgaccggataatggacaaagaaaatagcagcaacgaagaaaagtacccctaaactgatcgcaatcaacgaaatctgtttggttaagcgattgagttccagttgcaatgggcttagactgcgcttttgttgctgggttaacgcggcaatctggccgaattccgtatgcatccccgttgcaaacgccaccgccgttgcagtaccggcgccaacagtggtaccggcataaacaaggttggactcggcaaactcgccttgtccggcatcaaaagcaacttttttggattcgggtacggattcaccggttaaggcactttgatcaacctgaacggaggtagctttgattaaccgggcgtcaacagggaccgcattaccggcttgcagattaaacacatcgccagggacaatttgggtcgcattaacttgctgcaacttgccatcacgatagacctgcgtataggtcggcagcattttcataagtgaattcgtcgctttttgagcttcatgttcttgccagtagctgaaaataccattaataatattgactaaccaaattgcgatgcctagctccaatgtgccggacaaaatggcaacaaatccgctgacccaaagtaagatcgccatcacgctggtaaagttcttgagaaagatcaacaactgtgatgcctgcttttcgcgggtaatcgtattttcaccgtattttgcgagccgggttgaagcttcctgttgactcaatccggttgaagttgtgtgtaaatcagtcattaaatctgcaattgattcagtggcaaacttacgccgcgtctccttttcattcttcatgactcaagcacgtctcctttgaaaaaacgtttaactccattctaacgttctgcgggatggaaaacaccaaaagtgctaattttcatgagttggcggggcaggataagcgacttctccttgtaagccgcgctcaagaaaggtgacggcttcattaaccgcggtgttgagatcaaattgtgattggatatcgagtatgaccggaagcagataactgaacaccgtgccgaaaacgtactgcagaattcggatcaccggccaattaacgagaacgcctttttcctggtatgcggttagtaaatgcgtggcttcacccagaaattgcgtttgaaactgttctgctagtgtcttgctcaaagatgaatcgcgcaaaagggtggcaataagaatgcgcaattgagcttgattggtgatggcaaatgtcatgcgatcgcggacaataaacgttaaaaaagtatgcaaatcaggcagatgatgctcgccaacttcatgaataaactctgtgatcgcgctggggatgacctgttgaatcatcggagccaatagcgcacggagaataccttctttggttttaaattgtttgtagacagtgccttcgctgacttgggcgacccgggcaatttcttgggtactggtgcgatcgtatccttgttcggagaagagctttaaactggccttgagtacggcttgttgtttggttgatagctgactatctgcaagtgatgccgagaataaatcggtgatattatgcggtttcatcgagctacacttctttcataaattgaattaatttcagacttgacgatatttgcgcattgtcaaaagattcaggcctaaaaatagcaggaaaaagcctactaatgcaatgacatcagggtataaaactgctagtgattggcctttggtaataattccggttaacgcattggcaccataataaagtggcattaaatgcgcaatgggttgcagccatccaagcatctgattgacaggaatcaatccggtgaaaaaaatctgggggatcacaataataggaataaactgcaacatctgaaactcactgttggcaaaggttgaaatgagcaagccaagcgcaagtgctgttaatgccagcagtaaattgattagaaaaatggccggaatgctgccaagaatttggatcttaaagaccaccaaggcatagccgacaatcaaaaccgtttgaatgaccgcaaagatcccgtaaccaagtaggtacccactgatgatttcaccgcgacgaatcggagtcgccagcaagcgataaagcgttccagttgtccgttcgcgcagtaaggcaatgccggaaatcaaaaagacaaagaagaagacgataaagccaataagaatcggtaacaaagtatcaaagtaagtggattcagccgacccgtagcgatagtgggttgtcatgcgataattggtctgcttgggttgttgcgggatggggacttgtaccgcaccgtgcgtggcttgttgtaacgcgcccgccagtttatttaaggcaatcgcttgtgttttaaggctggtggccgcagcttttagtcttaacttaacggtggcagcctgtaatgtttgcttcaacagcgtgctttgtccctgatcggtgttggcaagcgttaacgtaagctgatcgccatgttgcgttaaaacgcctgcataatcatgctgtttgattatgcgggtaggtttttcagtgccaacgtgatgtaatcttacatgcttcgtatccatcgtcttggttaaggatgtttggacgccatgcacggccaaatcaacctttgtcgttgtgttggattgaaataagaagaagattaacgtcatgataaacaaaggcgcgataaacattaaggccagagtgcgtttgtcgcgtaacatttccttgaaaattcgtatcatcaaagcttcagtgcgcatcttgctgcctccctgcggctagaaataccgtttcaatcgaatctgcttgatagtcaacttgcaactgcttcggtgtgccttgagcgattgcttgaccattgcgaatcatcatgagcagatccgcttcttcagcgtccgccatcacatgggtggttaaaataattgtcacgccttgttttgccagtcgatgcaattcctgccaaatctggcgacgtaacgcaggatcgatgccaatcgttggctcgtctaaaatcaacaattgtggtttggcaattaaagcgatggccaacgataaacgtcttttcattccacctgaataatccttgacgggttgtttaagggcagtttgtaaatcaacaacgtcagcagcatacattaactgtttggtcagtaaggaacggccaacgccttgcattttggcaaaaaaagtgagattttcggctccggttaagctttcgtacaacgcatcggtttgcgccataaaaccaatgcggcctaataataatcgattgggaacgtgctggttaaaaacggtaaccttcccggcgcgaggacggatcatccccataatggtgctgatcaaagttgttttaccagcgccactaggaccgatcaaagcgagaatctgaccgcgattcaacgttagattgatgtggctaagcaccgtttttgtaccgtagccttgttgaagatcggaaacctggacgattgtttgagttgacatttgatttgcaccttctttttttgatagtgagtactcactcacctgcattgtaagctatttgttaaaaaatgcaactgatttacgtatctcgaccgatgcctaggaattgcggcgatgaggctaattgtgatgctgcgtttgaacttggaggctgtgaaggcggtgccacgcttcgtcatttgtttccgtcctcgcccgttcggtttctcgtggtataattattcagaagttcgatttttaacaataatggagggacgcggatgcgcacctatctcgcaaacttattaacttggtccacacttattaatttggttgacatcctcgtcgtctggtacgtcatttatcgcttgattatgctggttcgcggtacaaaggcggttcaattacttaaaggcgtttttgtgattgcggccatcaagatcatttcctggttcttgcagctgaaaacagttgggtatttaacggatttggtgattacatggagtgttccggcgctggtgatcatttttcagcctgaaattcgtcgcgggttggaacatcttggtcggggctcactgattttccgtagcaataataatcagcatgaagcagaagcacggatggtcaaggaattggataaagcaattcagtacatgagcaagcgtcgaatcggggcattgatcaccattcaaaagaataccggccttgaagattatatcgagacggggattccgcttgatgccgatattagcggtgaattactgatcaatatttttattcctaatacaccgctgcatgatggggcagtcattattcgggataatcggattgctgtcgctgcggcctatttgccattgtctgatagcaacctcattcccaaagaacttggcacccgtcatcgggcggcagtggggatcagtgaggtcacggatgctttgacaattgttgtgtcagaagaaaccggggaagtcacgattacgaataacaacaacttgattcgcaatctgacccgtgaagactacatgaagtttctgaccgcacagctggtacctaaagaagaagcacctgatcccaatccggttgtcagtttcttttcacgtctttttagtcaacgtaaaaagaaggagggcaagcaatgaatcgcttatgggataaaccatgggtcaatcggttgttagccttgcttcttgcaatcggtttgtttgcctatgttaatgtcgagagtattaataatacccggcaaagtgccaatgatgacaccaccttggtcgctaataaaacgcagaccgtgaaagtgccgcttcaggttaatgccaataccgacaagtattttattaccggatatccgtcaaaagtttcagtagcattgacgggcacggcttctttagtcacaatgacagcaaacacacagaattttcgcgtcattgctgatttaaccaatttgggtgtcgggaaacaccgggttcggctgaaggcggaaggattgaataaggatcttagctattctatttcgccaaagtcagtgaaagttgacatccaggttcgggataacaagacgatgccgattcaggttcggtataataaggcaagtattgcatctggctatgcagctggtgaaccgaaactttcaacgcgcactgttgaagtgaccggtgcccgctccgttatcgattctattgcgcaagtggttgcaaatgtctcgttagcgcataatacgcgtaagtcggttgatcaagaagtcttattacaggcactggatgacaatggcaataccatgaatgttgttctatcaccgcaaacagtgcatgtcaccttgccaatttcccagcccagtaaaaaaataaatgtcgagctgaagcaaactggcaatgccgtctccggacatacgtatgccttgtcgtcagatacaaaacaggttaccgtatatggagatcaacagagtttggacaagctcagtaaattgaccgttcccgttgatgtcagtgacataacatcaagtactacccgaacatttaatgtcacggatttaaacgatggtatttctgccgctagtccggaaacgattaaagtgactgtcagtgttggtaataccggtagcggtgatgacgacaatagtggtaataatagcagtggcgctgagagctcggctacttcatcaaagactgctagtacaagtgccagtgcttctcaatcaagctcatcaccagtgcttctcaatcaagctcatcaagtgaaagcacatcgacaagtgaagattaatgactggaagaaatgaggaagaattaagatgacaaagtattttggtaccgatggtgttcgcggcattgctaacaaggaattgagtccggaaatggcgtttcggttaggccggacaggcggatacgttttaacgcagcataaggaagatgccagtcgccgcccattggttttggttgctcgcgatacgcgaatttctggccagatgttggccgatgcattgattgccggtttactgtcggtcggaattgaagtgctggatcttggtgttattaccacaccggctgtggcttatttgattaaaattcaaggggccgatgccggaattcagatttctgcttcacacaatccggtagcagacaacggcattaagttcttcggcgccgatggttataaactctccgatgaaaccgaagaagaaatcgaagccttgctggatgcaccggaagacaagttgccgcgccctgctgcagaaggattgggaacagtcgatgattatcctgaaggtgcccttaaatatacgcagttcttggaacagacgcttgctgatgatttgagtggcattcatgtttgtctagacggcgctaatggtgccaccagcggattggtcagccgtatttttgctgatcttgaaaccgactttgatacgatggcgacaacgccggatggtttgaacattaacgccgatgttggctcaacccatccgcaagccttagctaaattcgtggttgaaaaaggggccgatgttggcttggcctttgatggtgacggtgatcgctgcatcgcggtcgatgaggaaggcaatattgtcgacggcgataagatcatgttcatcctgggcaactacatgaagtctcaaggtcgattaaagcaggacacagtcgttacaaccgttatgagcaatctcggcttgtataaggcgttggaagcaaatggcatgaagtcggttcaaacggcagtcggtgatcggcatgttgttgaagcgatgcgcaaagacggctataacattggtggcgagcaatccggccacatcattttgtttgactaccacaacactggcgatgggatgctcacgggtattcacttgctgaatgttatgaaaaagactggcaaaaagctttctgaactggcaacaccggttaaggactacccgcaaaaacttgtcaacgtaaaagtggcggacaaagaaaattggcaagcctatccggaaatccaagcagccattgataccgtggaaaaagaaatggctggtgatggacgggtactcgtccgcccttcaggtactgaaccacttttgcgggtcatggcagaagccaaaaccgaggacttggtgtcacgatatgttgatcaaattgtcgatgttgttaagcaggaaatggggagctcggaagcttaattctgtttcgaatggaatcgccagctcgtttagtttgagttagataaccaaagctcaaacttgatggtaaggtggatcagcattcgataaatctttccaaaagtggatcgaggctgaggcataattcgcagcttcaaaataaaatcgaactatttctcgttccaatcgagaaatagttcgattttttagattccttgcataagcataaatagactttaacgattccagtgccaaagcggagcaatcgtaggccagatggggctcagccgtggaacaacacagcgaccgggctttgtcgctgatgttgttaggcgacttggagactgccggtcttgcaggctccaagcgccgtcacagcgttccagcactatctggccggagattgcggagtttggcacggcccggaactatctttcttacttatcctccacagtattcggattttaatcagcatcagattctaaaatagaattatgacccagcctctatcaatttttttcggtggccgttgctaggcgtattctttaaatttttttaagactaaagtgcgcgtttgggcaaaaccttgttataaagggaaacgattaaccgaaatgccggcttttggcgatcagatatagaccggttttacttacgaaagtataccactaaaaaataggtgttgacatatcgctttgtaaaacatatagttagccttgtttttaacaataccaataaataaacctgtctaaaccaattttgagacagtcggaaaaggatgttgactatgtgtggaatcgtcggtgttatcggtaagaaaaatgcaacccaaatcttgcttaagggacttgaaaaacttgagtatcgtggttacgactcagcaggtatttacgttaatgatcaggcaggccatgatcatttgattaagcgggttggccatatttcgaacttggaagaagcagtaacgcctgatgttcaaggtgtgatggggattgggcatacacgttgggcgaccaatggcggtccgaccgaagccaacgcacatccgcaagtttccaacgatgaacgcttttatctcgtgcataacggggttgtgaccaacgctaatgacttgaagcaacagtatcttcaagatattgaattgcacagtgatactgatacagaagtcgtggttcaactcattgcactattcgctcgggaaggattgtcagccaaagaagcctttcgaaaaacgttgaaaatgattcaaggttcctatgctttttcgatggttgatcgtttggatccgacagttttgtatatcgctaaaaataagagtcctttattgattggtcgcggtgaaggcttcaatgtcgttgcttcagatgcattggcgatgttgagtgaaactgatcagtttgttgaactgaaagaccaggaaattgtgacgctaaccgctgatgcagttcatatcgagacccttgatggcaaggtagaagatcgcaagccgtttaccgtcaaagttgatgatggtgaagtttcaaagggaacctatccattcttcatgctcaaggaaattgatgagcagccaattgtgatgcggcgactggttgaaaagtataccgatgatcagcagcatgtggtgattcctgaagacttaatgaaagccttacagaatgcagatcggctttacattgttgccgcggggaccagctaccatgccggcttggttggcgctcctttgtttgaacagctggctggcattccaaccgaagtccatgttgcttcggaatttgcttatcatcagccattactctccaaacatccgttgtttatttttctgacccaaagtggtgaaactgctgatattcgtcaggttttggttgaagtcaaagcgcaaggttatcagacactgacgattaccaatgttggcagctcaacccttgcccgtgaagcaactttcaccttgttactgcatggcgggccggaaattgcggtcgcgtcaaccaaggcttacaccgcgcaaattgcggtagaagccttggtagccaaagccgttggtgaagcaaaaggcttacaaaacgctaaggactttgatgtgattcaccaattaggtttggcagcaaccggccaacaagcactgattgatcaaaaggatcggattcatgaattggcaaccgatatgttcaaaaccacgcgcaatgctttttacattggccgtggcggcgactactatgccagtcttgaagccgcattgaaactcaaggaaatcagttatgtgcaggctgaagggtttgcggctggcgaattaaagcacggcaccatcgctttaattgaaaaggataccccagtcgttgccatcatctctgacccagtgaccgctgctcggacccgcagcaatgccgatgaagtgcaggcgcgcggagccaaagtgttacacattgccatggcgagccaagcccaaaaaggtgaccagattatcgtcgacgaaattgatccgcttctggcgccactggttacgatcatcccggcacaactgctggcttacttcacgagttccgatcgtgggtatgacgttgaccgtccccgcaacttggctaagtcggttactgttgaataggtctaagctcataatggcgtgaaaaattccatgacagttaagttgatatttaaatttaatgtcagtggggattaaacaaaaaaactgttcgccgaatgtggcaaacagtttttttgtttattgaaggctaccgagcgatctaaagaaggctacttaagatacgcttcacttaatgccatgaattgttgggcatctttagcggctaaatcaattccttgctgccaaaattctggttgggtcaagtcaacgccgagatgctttttcgctagtgcttccgtgctcatgttggcggtgtcccgcaataaggcaatataatcatcttcaaaatgatcgctttgctgtgccttagcgtaaataccgctagaaaacaggtagccaaatgtatatgggaagttataaaacggtgggttgtcaaaataaaagtgcaacttatcggcccaatacatcggatcaaatgaactcaagccgccagcgtaagccttctcctgagccgcggtcatcaaggctttcaggcggggaacgctgacaataccatgctcacgttcttgatagaaactgtcttcaaacaagaatcgcgcatgaatgttgagcagcatcgctaatggattggccatttttgcgtctaataagttgagcttttctgccggttcgctagcagctttcaccgtcgcatcggcaacaatcaattcggcaaaagttgaggcagtttcggcaacgttcatggcatagttttgccgcaaaaccggcatatccttcaaaatagaactgtggaaagcatgccctagttcatgagcaatggttgatacaccagacgccgaaccgtcaaaggtcatgaaaatgcgactttctttgacatccggaacgctggtcatgtaaccgcctgcccgtttgcccggtcgatcttctgcttcaatccagccattttcaaacgcatgttgcgcaaaggcggccattttaggtgaaaacttcgcaaaattattaacaatgaattctgcagcttcgtcaaaagtgtaggtcttcggcttgaagtcgccaacaaccactggtgcccattgatcttgccattgcatggtggactgcccggttaattgggctttgcgggtgagataggcagcgaagggcgctttattggcgctgatggtttgccacatttgatccaaggtggcacgcttcatccggttatattgcagtggcttgtatagataatccggatactgatgtaagcgatagttggtcaagcggaacccggcaatgtggttgagggtttcgccaaacaaactggcatgatcgctccaaacttgttcccaaacattgaaaacgtccttgcgcgtcttaggatcaggcgcaccttcaaacttgttttgcgtttggccggcacttagctcggtcgtttcgccattttgagtgatcgggaacttaagactgccactgagcgttgtatagtgattactccagccggcgaatccatcaaccgccaagtcattgatcatggtttcggttttatcatcaagtaattccttggcttgatcacgaatttcacttaaaccgaaacgactctcagccaatgtaccagtagccgtcaactgatcgaaagcagtttgtggcatgccggctaatttctttgccaaggggttgttaatgttttgaaaacgggtttctagtgttgtaagttgtcctagcaggggaccggtttttaagttggcagtatcggcgctggcaatcatttcgacaaaactgcctgtggtgccgagacctttactgatatcttcaaaaagttgccaaagcgttttgaaatcggtaaactcaggggcatcatcttcaggcgaccacgctgctacttgggcttcaagttggggcaattcgtcggtcactgtctgaatccgtgcggtaagttgtggcgagtcgatgccacctgggaagattgaatcaagattccaattaatggggtaagacataacagcacttcctttccaaataggttcattatacagtagatgagaaaagtatgagtgaaagtaggttgaatttgtgaattcttttaaacggcattggggattatggttgacggccgcaattttatttgttttgttcgtcagttctagcatgacttataaggaacaaacaaccgtcccgttaatggaacggttgttgcataatgagccgttcaagccattcttaagtagcattcagtttaattatgccggcgagacacagtcagttgctaaagtcggatattttaagttcgttgaattttttgtgcgcaaaggggcccacgttagtatctttttcttattgggcttgggtttgacgcaagggacgtttatgtatcaaaaaaatcggtggttgcattggccgctgatggtgttgagttgtaccggaattgcagcatttgatgagtttcatcaaatgctgacaggcgggcgcacgccgttgtttcaggatgtgatgctagacactgttgccgctgcgattgcggtgaccttcatgtggggatggttgtggcgtcagaagcggcgttgaataaccgcgcgttctttgctataattttaacgatccatatgcttctatacttatgaaaagagggtttatcatgtcaggacattccaaatggcataacattcagggccgtaagaacgctcaggatgcgaagcgtggtaagattttccagaagttatcacgtgaattatacatggcagcaaagcaaggtggtcctgaccccagtggtaacccatccctccgtttggtcatggacaaagccaaagctgccaacatgcctaaggacaatatcaagcgggcattagacaaggctagtgatcgcgatgcggctaattatgatgaagttacctatgaaggctatggcccgggtggcgttgcaatcctggttgaagcgttaacggacaatcggaatcgaacctccagttcagttcgagttgccatcacccgtcatggtggcaatatggcggcagccggtgcggtttcttacatgtttgatcgcaaagggtatctcgttatctcacgtgaagcgtatgatgtcgatgaagatcagatgttagaagatgcactcgaagcaggggctgaagatatgcaaacttcagacgatgcttacgaaatctacaccgatcccaaagaattcgcacaggttcgtgatgctttggaagaaaaagggtataaattcgtccaaaacgaattgacgatggtaccacaaaatctgaccccgattcctaaagataaagtcgaacaattccaagccatgatcgatcagctagaagacgatgatgatgtgcaagaagtctacacagctggcgactggccggacgattaatgagttgaataaatgagtgaagaggctgggctatcattcccagtttcaaactaaaggcgtactatttctcggatttgacgagaaatggtacgccttttagattctctacattagtatcaatagcatttaacgattttagcaccaaggcggagtaatctctggctagatggatggcgttgcatagctagggcggaaacagtgcggctaagggacagagtatgcgcatcttgagacataatgatcgtattttaatcaccgtgaccaacgtccttatgtgcagacgatgacatccgaaaaagcatgacgggtaaattttttatgttaatgacaaactcgtccttgcctgcgaattcttttaatgcaggaggaaaaaatatgcagtcagtgaaaacgttattgaccaacgcattagccaaaggagccagcgatatttactatttgccaaatccgcatggttatctgattcggcttcggttaccgacagggttagtgactttagggcaactggaaacgcgcataggtcagcaagagattaattatctgaagttcatggctgggatgaatgttgcggagcatcgccgcgtccagttaggcgccttttatcatccggactcaaatgtctttctgcgtttaagttcggttgcggattttcggggccgcgaatcattggtggtgcgactgatcagtggtattcccgatgcgcagggtgcacgtcagttgttggatcggttaatgagtattttgacgcaacgccgaggcatgttgacattggctggcccaaccggatcgggtaaaacaacgttactgtaccagcttgcaactcgcttggccgcctcgaaaatggtgctgtctattgaggatcctgtcgaaattaaccagccccagtttctgcaacttcaggttaacccagaagcggaaatgagttatccgcagttgttaaaggccgctttacgtcatcgcccggatgtattgctgattggtgaaatccgcgatcggcaaaccgcccagagcgcctgtgaagctgccattagcggtcatattgtgcttgcgaccgtgcatgcacgttcggccaacgacaccccactgagactgactagctttggcttacctgccgaattggtttctgccgccttaacagccagtgccgcaatcacgttgcagtatcgacctacgattcatcctgtcgctgaagtggttgtttttgagccggcgcatcaaagcggtgcaacggaggtggtttcgtgaaagtgcctctgatcgttcaggaacgtttttgtcgtcaaagtgcagccttaatgacggcgggtttcaatctgagtgacgtgttcgcctatttgcaagtgagtttgcctaaacacgccgcgatttggcaaggaattgaaaacgaattggctaacggcatggccttttcggatgcagttgcacgccaggatctggccccgattcttttccaacaattgcagttggctcaggttcatggtgacttagcgaaggcgttgacgattgcggcggattatcttcacttgcgggttcgcaatcggcaacgcattgtacagttgctggtttatccgtgtctgttattggcaatgctggtggtcttacagattgtcgttgtttttggcgttcttcctgcactttctttaccacagtcgaatttagtcgcgcttcaattgattgggttgggcgtggtgacagtgattggactcttgggttactgctactggcatcgtatgtcgccgctcaaacgtctactggtgttacagaaggttccggggatgcgccaactgctacgaacttattatcagtttcagtttacagcaggagcagctcaatttttattggcgggtgcagatattgccaacttttgccagcacttagcaaccttagacggaccgatggggaaattaggcacacgcattcaggcgaaggttcaacagggacacgaattaagtgtggcgcttcaagagccgttgattcccgctgaggttgcccgtttgctaaccatgggccaatcgcatcatttggtcgcaaccgggttaaaactttttggtgaacagcttttctcgcggcttcaacagcaattggaacgactggtgagcttggtacagccgtttttgtttctaatcatcggcggagagattttactggtgtatttacaaatcttattaccactttatcaatctatagggggttaagcatgaaacgaaaaaagttgcgcgcatttaccttaattgaagtagttgcggcgctgggggtcattattctactgacgctcgcgctggttttgaccattcagggccagatgaaacgtgtcgatactcagaacctgaaagcaaccgtggcgacggtcaacacgcaattggaaatgacttacaatgagccagatcacggcggggttgattttagttctccggatcaattagttaaaaaagacgtgatttcacaaagccaggcagacacccttagaaaaggcgggtttaagctgacagcaggatcaccaccgacatttagcaaatgaaacggctacatggttttaccttgattgaagtcgtggctgtcatgtttgtcataactgcattagcaatcgttgcggttccggttggccgaaatgttttaacgcaataccgcgaacgtgaatttatggaggccttggtggaagaatgggaaatgctaaaaatgcgggcgagagctgaaccatcagatggcaatatgtatgtgaatggtgaagagagggaagttagattcgtgactcaaggaacgacaaagacatttcctttcccggtatcactgacatttagtgggaggggttggatgagttgtaatcctcatgggaaaataaagcaagcgggaactttaaacttttcaaatgagaaaaagtttgcttgggtgattacgttccagctgggatgggggcgagcaatattgaccaaaaattaagtggggtgttgttagtcgaacatcttgcggctttgggcgtggttctcatggctgtgggttggttggcgttattgatgaggacttatcagcaagttgtcatacctgtccgacaagaaaccactgcttactatgccgctcgcgttgctttaatgcgggtgcctgcgcgtggtggggaaactcaggttagcgttggccctgatgtttggaaggtagtgatgagcgcaaaggaggttcgggttgatgccaataactcgacggccagctatacctttaacccttagcgccttcaccttgatcgaagttgtgattggattaggaatcatagtcgcggtgatgttgctttggtcgccgcttttgacaggcgttcaacgttttacaaatcaagatcaatatttactgcatgcactgcaagcagatgcagacttacaggctaatgtgcggacccatcggatgaaactcgagtcgcttaaacagaaacgggtcaggcttcagggaaaagatggtcatcaatcgaaattttatgtttttgagttttataccaaaaatggcaacagtatgattcgcgctagaaccaatgatgggggccatattccattatttatgcaaatcaagtccggccaatttttggggtccgttcatggctttttgtatgagataagattgggtactaaccagacttttgaaggcggggtgcggcttaatcaatgaaattacgtggaagtgtgctggttaataccatcattttattcggtatatttttgacgatgacaattgggatgtttaagcagtttaaccgctggcagcagcattatcaaattattaagcaagtcgaaaagtcccagtttaagtcggcttattcgcagtggcggcaaaatgcggaaggagtcaaccatcatgataagtcagaaacagctgacagtgcgagcttgaaatctagtcaggcgagtgaagtaagtgtcagtccaacgaggtcaatgccagtggttgaaaagacggtcagtgagacagataccaaatcggtgccctaggttaaagaatgatcccgcttgaataaggtatttccaatcggtacactggtaaacggagcgttgaaggggcgcgttagcagcagactcccaataaaatgcttattggccatatttggtcatgatgatgcgcgcctcggttaggccggttcgcgctcaatcataacgcgctcaccagcccagaagtctgcgtgtaaggacctcagtcgcaatgaccaaagtgcggccatcacgcccaaggctgcttacactccgacttctaagcgcgccggttcgcgctcaatcataacgcgctcaccagcccagaagtctgcgtgtaaggaccttggtcgcaatggccaagcccgggccatcacgcccaaggccgcttacactccgacttctaaccgggctggttcgcgctcactttatttagggggttgtctttgtggcgaatgaacaccttgagaagctttatcatgttttggatgaaagcacgacgattttgcatcagcagttgaaatctactgatattgcggcaattaccgaagctggcgaagatctttcttctggtgaagtgatgcaagaagatgggttgcctaacgatgaagctaagaagaaactggaagctttgtttggtcaggtgaagttggcaacatatgaaccggaagagatacggcaggctttgcagctggtactggttaaagcgatcaaagttgatgggattgaacccaataaacagatcacaccggatgccatggccagtcttgcaacctttatggcgaccgtttttgatcagcagcagccgagccaactcaaagtggcggacttggcagttggaagcgggaacttgttgtttgcagtgatgaatcaactacacaaagaacgtgacgttacggtaaaaggttacggtgttgataatgacgaggccttgttggcggttgccgggatgagcagcagcttgcaacacctggacgttgaactgtttcatcaagatgcattggatgggcttttatttaaggatattgatgtggtggtctccgatttgccggtggggtattaccctgtagatgaacgggcaaagaaatttgcgactgcagccaaaaagggtcattcatatgcgcatcatttgctcattgaacaaagcatgaaagtattgaagccaggcggattggggatgttttatgtaccaagtcgggtctttcagtccgaagaagctgccggtttaaccgcatggctggcggaaaaaacttacttccaaggcttgcttaatttgccggatgacttttttgccgataagcaagcagaaaagagcctgttgattcttcaaaagccaagtgcggacgtaaaacgcgctaagcaagtcttacttggtcaattcccgaatttgaatgatcgtgaggcattcgccgcctttattgcaaaggttaaagactgggctgccgccaatattgcacaatagggcgcggcggcttgtctttgaagactttgcggaaatacaccagatgtgtcgataacaatgtggcgagtgggatcatcgctaaactggctcttaaagggaaaaatcaatcctgcctattgctgattttcagaaatgaatcgttagacgtcagaaaactggcgtctatttttgactcaaaataagttgccgagatgattcttcaaagggcattttctgctttttggggaacaatcaggtagaatagatagttataaacaggaggttggttatgtcgttattgagtattgcttacgtgctcattgccattgttgctgtcggcgtcacgatttttgacattgtgcaggtacggatacgagcgcgtccgaaagtatggcgtattcttttatatctggcagttgcggcgtttagtctggtgttaaccttgcaacaaagccgttcctttgacgacttgattagcggcgggttcattgttgtcatgtttctttgttttgcaagctggcaaaaaggtttagctgatcccgctatcattggtggtttgggtagtattcgcatgtatcagaatctgaccggggttgtgttacaaacgcagcctaaaggaacggttttgttggcacaggcgggaaatctgacggtgttaaaattgcagtttcgtcaggatccgccgaccattaacgcatttttagctgacaagatgccgcctgaccgcattagtattgacgattaggtgtgaatgatttggggttttctgaaaatggtgtataatttttctaataccgcatgctattaatcagacggcaacagctaccttggccgtccgcattagtaagtgtgacgcaaggatagtcagacaatgattagttttaagtttggtttgtgccgttgaatcaagatgaaaaataagtttcaagactgttttatgcttttaaaggaggatgagtatgcaagccgaaaaagatgatcggcctgaactagcacgtcatttgaagagtcgccatgttcaactgattgcaataggcggcacgattgggactggcttgtttttgggctctggtcaatcgattcactcggcaggaccgtccattttatttgcttatttaataactggtggcatttgctttttgctaatgcgtgcattaggcgagttgttgatgtctgatgtggattcacatacttttattgatttcatcacaaaatacctgggtatggatgccggttgggtgactggctggacttactggatatgctgggtagcacttgcgatggctgaagtgacggcgattggattatatattcggttctggttgcctgatgtgccgcagtggctacccggtttaattgctttagcgatcttgttgttgttgaatctggtcagtgtcggattattcggagaagcagaattctggtttgccttgattaaaattgtggccatcattggactcatcgttttaggtatcttcatggtgattgttcgctttaaaacgccacttggtcatgccagtcttggcaatcttgttaacgatggcggctttttccctaaaggcgttggcggttttctcatgtcactgcagatggttgtgtttagttttgtcggcattgaaatggttggcttgactgctagtgagaccaaaaatccacataaggtgattccggaagcgatcaacgaaattccaatgcggattttgctgttttatgtgggggccttgtttgtcatcatgtgtatttatccatggcggcatgtctccccggttaacagcccgtttgttgaagtctttaataatgtggggattccgtttgcggccgatatcattaactttgtggtattaaccgcggcggcctcggcttgtaattcatctatttttagcacggggcgcttgttattttcgctaacgttgaacggaaaaagtcaatcagcgcagtggactgccaaactttcacgacgccaggtgccagctcgggcgattctggtctcaaccggtgtcattgccgtagcggttgtcttgaacctttttcttcccggttcggttttcacgctggtttcaagtatggcaacgatcagttttctgtttgtttggggcatgatcatgttggcacatttgcggtataagaagttgcatccccacagtaccgactttcggatgccattgtacccatttgctgattatcttgtgctgggttttctgctattaaccgcagtaatcatgatgtttgatcgtgcaatgttatcggcgctgatcttcgcaattgtgtggattgccacactctttatattgcggcggctgcggcgagcggaaaaagcagcgtaacgcacattgttgacaggaagaggggctttgcgtggtaaaagttgtgacttatcagcgactaaccgatgatattgtgactgcccctaatcaaaaagatcggcttcctgctaattactgttggaagccgacgttgggttttcgcttcaaagccgatctggtttatgccggtgcgtggctgtttgctcaggggtattggcgcatcggggtgcgtgtgcgtcatcgcagcgttttacgccaggcagccggtcgcggttactttgtttatggcaaccacacgcagccatttggggatgtttttacgccgatgcgcgttaatcaggcgcgacgggtggcgacattagcggcaccggcaaatttgagtgtcccgattcttgggcggttggttccatacggcggtggtctattagtccccaagcagttgcaccaactacgcgcctttcatgctgaaatcaaacggctaattgcggctaaagaagtcgtgatgatctatccggaggctcacgtttggccatattatactggtatccgcccgtttgagtccggtgcatttcattatccggttgaactaaatgcacccgtatttgtcaccaccatgacttatcaacggcgacactggtggcctcggcctaaacgcgttttgtatgtcgatggtccgtattggccggatcagcagctgccattaaaaatgcgccaaaaacagttagcaaccacagtccggaccgtaatgatgaagcgagctaagttgagcaatgttgcctatattcactatcagcagcaaaaggaggcgcaaccgtgaccatgaatattttattttgcggtgatgccaacatgacagatggtgttttgcttgcaaccttatccttaatgcggcaaacgcgtgagccgctgcatatttttgttttgaccgcgacactgacagttaacgatcatcgttataagccgtttccagttgcgaccgtcgcacaaatgaccgagttgatgcaaaaagaaaacccggcgcatcagttcacgcgaattgatataacgaatttgtttgaggcaaatccgccgcgcgctaatctaacaacgatgtttacgccttattgtatgttgcggttgtacgccgatttggtgccacagttaccggatcgcatgctttatctggataccgatgttatttgtcggcggccgtttgctgcgttttaccatgagtccatgactggtgttgatattgccggcgcgttggaccactatggcaaatggtggtttcatcaccggttgatgtggtttgattatctcaattccggcgttttgctgatgaatcttgctagaattcgcgcagatggtttattagcgcgctgccgccagttgttacagcagcggtggctgtttatgccggatcagagtgctttaaataagctggccaagtgtaaacggattctgccgccaaaatacaatgagcagcataagcttgagccggatacggtttttcagcactttacgacatcgtttcgcttttggccgcgttttcgcattgtgacggtcaagccgtggcagattcatgccgttcatcagcagctgggattgcatgaatatgatgatttgctgaaagattatcgccggctagcacctaaattgaaagaagtgtcctaaatgccaactccaaccacggttccaattttcttttccgtcgatgatggctatgttccttgtctggccgttgctttgacttcgattcgggcaaataaaaatccacgtgtcaattttgaaatcaatattcttaataatggcttattacccgccaatcaaaagcggttggctgctttagggacatccaattttgacatccgctttatcacgatggataaggttacgcgacagatcagtggtgatacgaacaaactgcgcggtgattacgtgaccctgaccatttattttcgcttgtttatcgcggatatgtttccacagtatgacaaagcgatttatattgatgcggatacggtggcagaaggcgacttgaccgctttgtttgcaacggatttaggtgataacctggttgccggtgtggctgatccggtgatgatgacttatccggaaaccatgacttacattcaacgcgatttcggcattcagccaggtaagtatattaattccggtgttttgttgatgaatcttgcgcagatgcgtcaggagcatttttccgatcggttcttgcacttgttgaagacttaccattttacgatgattgctgctgaccaggattatatcaatgtcatcgcacaacatcgcatcaaatatttaccgaagctctggaatatgcaaaccggggtccctgcggctgcagagactggtggaaagttgattcactataatttgtttggcaagccttggcattatcatcatgctaaattaggcgatcgcttttggcggtatgcaccggattcgggatttgaagcggaactgaagcagcagttggcggcatttacgttggcggatcagcaggctgatcggcaaagtatgagtgggatgttgcagacggctattgctgtttgccacacggagaatacaattttgaatgccgttaaacatggcgagcaggtggcgctatgaaatcgggccggtttgtcggtccggatcgcgcggcagttgttggcaatattcggcgtgcggtggcggctaaagcgtttaatattaaagtcgaagaacatgatccggtgttttccaagtcggaggagcagcggattgtgacacattacttacaacagcgccgggacaagttatttaagctcaagacactggtttgtcgcttggtcgttaatgcctatgcgttacaggtgaccaaagatgttgaagtagtcggggtcgataaaattcggggcatcaaaagtggcggtgtgattacaagcaatcatttcagcccgtttgaaaatatggctgtgcgtaaagccgtgcatctggcaggtcggcaccgcatgtatatcgtcagtcaggatacaaacttggcaatgaaagggctgctagggtttgtgatgaaatatgatgatacgattccgctgtccggacgccccagtttcttaaatggtccgtttaaacaaatgttgaatgctgcgtttgcgggtcatcactgggtgttaatctatcctgaacaggaaatgtggttcaattatcgtaaaccacgaccacctaagcgcggcgcttatttctatgctgccgaggcgggcgttccgattatctcctgttttacggaaattcgtgatctgccagtccgcgagaatcagcaactgcgcgaagtccgttatattttgcatgttcttgatccaatttatccggatccgaagctttcagcgcgcgacaatagtttttacatgatgcagcgtgattatgtccaaaaatgtcaagcgtatatggccgcttatggcaaaacgttatcctatgcttttacgcagcaggatattgctggttgggatcctaaacagcaagccacagaatagactaaccaaaggcgaacttttctttcgatgggaagttcgtttttattttgtcatttggcgcgatctgcttaatgggtcgaaccaagcattagcgaaaaacggtacttatgtgacaccgatgctgacggcagaatgccacttatagaaaggtacatcaaaacagtttatatgctataacaaaggtgatgtttatcgcggaaaggggaccctaattgatcgatgttactgacgatcatgcttttcatttatataatcaaaagatcagctatatttgtgcgttattgccaaatggtcagttgggccatctctattttggccccagattatcgttaacgactgctgatttgacctatctatcgcaaggttccagtccgtttgcgtggatggctaacttttccgacgatcagccgtttgcattaggtgatgcgcaacaagagtatccagtttatggaactggcgattttcggcaaggcagtttaagtgtgacccaagcagacgcacccgtgtatccgaattttgtatttaaagattatcaggtgagtcacaccaagatgcggaatttacatcatccaacgagctttggtaatccagccctgactgatgttttgacaattcaccttgaagatgaaacggcgcagttattattaacgctgcagtatacgattttttcggatagtgccacggtcgttcgggcagctactttgacgaaccaaggtgctgagccggttatgattgagcggatgttgagcggggcgctgaatttaccccaaggccgttatgatgttgttcacttgtcaggtaactgggccaaagagcggcacattcagacacagcctttgacgcaaggaacgttttcagtggaatctttgcgcggggcatcgagtcatgaacaaaatccgttcgtcgcattgcacgcagccggacaaccatttgctgttggcgatgcttacggtgcgaacttagtctattcggggaactttctggatagcattgaagttaatgaatgggatcagacgcggcttttggctggcattcatccggcttattttagctggcgactagatccgaaaaccagttttactacccctgaagtggtcttaagctttagttcagcgggactagctggtttatcccaagtcaatcagcgttttgtggcccggcatattattgacccgcaatggcgccaaaagccgcgtccggttgttttgaacagttgggaagcgacctattttgacttgaatgaacaaaagctgttgcatctggctaaattgggacgtcaggtgggggttgactgttttgttcttgatgatggctggtttggtacccgtgataatgatttaagttcattgggggattggttcacaaataagcataagtttccggatggcttagggcattttgctgaggaaattcatggcctcggccttcagtttggcctgtggtttgaaccggaaatggtatcgcctcgatcgcaatttttccagaaacatccggattgggtggtccgtcccaagcgcggccgaatgtcgattacacgtcatcaatatgttctggattttagtaatccagcggtcgtaaataatatttttgcgcaaatgcaacgcgtcattaccgaaaccaagcttgattatgtgaagtgggatctcaatcgcagtattaccgaagcctattcaccctacttggcaaaaattgggcatcctcaaggtgaattcttccattgctatgtacaaggtgtctataccctctatcaaaagctgctcacggcctttcctcacctgctgattgaaggctgtgctggtggtggcgggcgctttgatttggggattctcttttatagtccgcaaatctggaccagtgatgattctgatgcgatcgaacggttggcaattcaatccggaaccgcactggcttatccgttaagttgtatgagcaatcacgtgacggcgataccgaatgaacaagtcggacgttccacaccgttggctacgcgatttcgtgtggcagcatttggcattctcggctatgaattggatttgaccaagctggatgatgcggcattggcaacaatcaaaaaccaaattgcttattatcatgaattacagccattagtcttaaatggtgattttcggttgcttttgccacgtcaatccaacagccagaatcaagtagcatggctgctaagtgatcattaccgcaagcgtttagttttaggcttcttccgcgtccttgccgatgcagacagtcgcgccgtgcagtatatgaagataccggttgcccagccaaaccaacgttattgggtgaacggtcacacagggccggtttccggtgatgtcttgcagcgggttggcgttcgcttaccgatccaattcaatggcgctaaccggcaacaagcccaattgatcggtgactatcaatcggccttattgacttttgatggggtaacagcaaccaaaaccggcaagcatcaacctgagattcgcaagcagcagaaggtcggacatgcttgagacgttactacgcggctcggatttagttaatcgcctagtttgaaacttgaacagtaacgaaaaaaagctcgttgcaacgggcttctttcatttcatgatatttgattgtcgccattcaacgacttatgatgccgaatgacggcttttcacgagcagcaagatgcctgaagcaagattcatagcaccggcaatgatgctgaggctgccagcaataattgttatgatactgagtggtaaatggttggcttttttcaattttgacattcctttctagggttgcggtggggtcatagctggcgtaaaaacgatggcgaaggttaatgatttcttcctttcgtttaatatccgtattttaacaaatgtaactgattaaaggtgaagtttatttggtaacgttaagtgagattcttatgaactgaactcactttgaataggacatttcgacagctaaaatcggacactaaatggacactttttgtgcacttcacttcaaaaacacccccaaacaacccaaaataaaaagccccgaaacgctgatttaacagcatttcgggactaaccagaaacaagaaaaagggtcaaaatggaggtgaggagaatcgaactcctgtccatcacccctgctacatgcggctctacacccatagccgatttatttaaaattcgctgcgatgtcgcgccaaccgacaaggctaacacaaggcagctaacctactagtctcttgttgatgcctcaggtggcaacatcaaccgtagctcaatgatttgagacccagacccgacccttgagcgaagtcggaaggatcacgctagctggttattaagcagctaaagcgtaagaattttcgttctttgcagttatattaactgttccgttgatgacggagccgagcctccgaggtgcaccgcatgcgcgaaaagcaatgtcgagaccattacacccccaagaaggtgcaaatgatatattaccacggtataattaaacttgtcaaaacatttgcagttatcattgtactgacgcacacttaggttttaagctatttttatgggggcatgtctatgatcttacttgttgcaggatgcatgcaattactaatgggcatccttcttgctatttttcgaccgcgtcatcaaaccggcctgtggggctacacatcgtatctcgccagtgtcaacgctgatagttttcggttggcacaaaggtggttttatcaggcgttaattgccacaggtgccgttgaaggacttgctggctgggtaattcaccggttagcgtgggataactattttattatctggctttttctggctgttttgttattcttgcccggttttgtttataccgaaagtcgactgaagcattatttggaggcacacgatgcgctgccgtatgattatgttgccccggatgatgcgccaaggcctaaacgccgtaaaggttttaaagatctgtgaaatgagggattcagcagtgaaactattaatgattgaagataatacaagtgtggccgaaatgatggccatgttcttccaaaaagaaaaatgggaagttgtcaacgcctatgatggtgaagaaggactggcgaaattcaaagaggcacctgacagctttgatatcattacgcttgatctgaatctgccgaaaatggacgggatgcaggtggctaaggaaattcggcaaattagcgagacagtgccgctaattatgctaactgcgcgtgataccgaaagcgatcaggttttggggttagagctcggcgctgatgattatgtcaccaagccattttcgccgattacattgattgcgcggattaaggctttgcatcggcgcgccgaggttggagccgaagctggcgcggaacaagcagcgccggaaactaaggcagacgggtttgatgttgaaaccgatcactttaaactcagcacaaagactagggaagcctatttgaacggcaaacagatcgaagggttaacgcccaaagaatttgatttgttgcataccttgtccaagagtcccaaacaggttttctcccgcgaacagctactgcagctggtctgggactatgaatactatggcgatgaacgaaccgttgatgcgcatatcaaaaaattacgtcaaaaaattgaaaaagtcggtccacaaatcatccaaacagtctggggcgttgggtataagtttgatgattcggggcttgatcaatgaaaatgctttatcaacagctgatcggctttttttcggtcatcatggtgacgctggtgatcgtgtcgattctgtttattcgctcaaccaccaatacggtttgggaaaatgggttcaaacaacttgaacagtatacggatgttttgaaaaataacgcggttgatgaaaatacgtatgtcatcaatgcgcggtttattcagaatgccgaagaaattttgagtgaccagcatgttcattttgttatttatgatgcgaataacgttgcaaaatatcccgtttcgcaaaagggccggatgactgcgattaaagcgagttattggaaaaaattgaagcagggatcagcagttgcagtgccggaaatgatgacgaatccgattagcggtagcgcacaaagcatgacgatttattatcagccggttttcttaagtgaaaaactgttatttgtcattgctgcatttgcgccggtagagcagattcaaagttcgattaacaaaaccgaacacaatttgttaatcgcatttgtgctatcaacattagcagctttcatcattagttacttcattgcttcttatcaggttcgtcgcattaatcagttacgtcaggcgacgcatcaggttgcggaaggtaattatgacgtgaccgttaaaatgaaaagccgcagccatgatgaagtggccgaattagcggatgattttcgcgatatggtgaactcgttaaaagcaagccaacaggaaatccaacggcaagaagatcgccggcgtcagttcatggcggatgcagcacatgaaatgcgcaccccgctgacaacgattaatggtttgttggaagggttggcttacgatgcgatccctgaagaaagcaaaggcaaaagtatcgaattgatgcgcaatgaaacgaatcggctgattagattggtcaatgaaaaccttgattacgaaaagattcgcaccaatcagattcttttaagcaagcacacgtttaatgcccgtaaagatcttgataacattaccgagcagctaacgcaaaaggccgaagaagcaggcgataccattacgattaaagcgccagcccaattaccgacctacgctgaccatgatcgttttgtccagattctgtttaacattgtccaaaatgcggttcaattcaccaaaaacgggcagattacgatcggcggtaaattagggtatcaccaaaccgaatttaccgtcagtgataccggtatcggcatgtccaaagatcaaatgaagaatatctgggaacgctattacaaagccgacccatcacgcaaaaatacgaaatacggcgaatccggacttggtatggccattgttcatcaattaatgggcttacatggcggaacaattgaggtggattccaagttgggttcaggaacgaccttcaccttaatcttcccggatgaggcgacagcacctaaacaaaaacagccagcaacaaaatcatcgtcaagcacaacgtcatcgacagccggtgccgccaaaaacactgacgctgcattaaacgaccatcccaagtccgagtaacagtagcttttctggacatgcgggtggatggtgaagcgttaacaggcggtgatatgattgttgataggtaaaagcaatcacatttattgggcgccgatccccaaacgcccctcaagaagtgtgaagcaaacaaataagcactaaaaaggagacccttatgaccatccgacgaatacagcagagtgattttgctgatgtagacgcattattgcataccgcatttagcgccagtaaacgcggctatcatgacgaagcagcgctcgtagcagaattgaggcgaaccactgattatgaagcggctttagaagtcgttgccatgattgatggacatttagtcggctatgggctcatgacggcggcaacgattacgccggatgcgcatatgaacggagtagcactttggccgttagcagtcgcaccggcgtatcaagggagcggtttaggcatggccattgtctctgagcttgatatgcgggcaaccgatctacgccgtgattttgtcagtgcgattggtgatcgtcaattcttcggccggttcggatttcgtaaagcagccgcctacaaacttgaaccgccgttttcaatcgttgccgaagatcatctcattaaggaactcgtgcccggtgttctagccagtgtgcacggaaaagtcaattatgcacgcccatttcttgccaaaatgccgaactagacaaattaattgaatccgttgataagttgcaggttactctgcagcttattttgctggtcgttgccttcaaacattacttttctttgtggtgggctgattgatgtgccttatgtaaggtgccgatacacaggccgccactgaccaaagcaccgcccattagtgtgttgtcagtgacatgtggccagtattctacaaagatgacgaaaccaatgataatgactgctgtcaatagttgccatgacagatgatagggttgccgtgccttcatttaaaagccttcttttttgggtcttaactaactgattgtgtttcgaaactagcaggtgtggagtcctgacgcgtggaaattttccaacctttacacgcaggtttctatgcccgtcaatagcatcatattttcttaataaaaagtcaccatcagcctactgcaaaaatccttgagtttaaagcccttacctgtgagttgctgtgatgatcgttgcatatgtgtcaatttaacgattgattcggttgatgattcatggcctggcgaaatcttttaaacaacagggtttattaggtatcacaacatgtcaagtcggttacagtttaacgattactttgcagaagtgacaatgactgttacaatatgaacatattcaaacggctatcaggtagttcgtaaggtgtggtggctgtcaattattttggggggattttgcgtgaagcagttttatattgttgacagttcaattcttccagacgtggttggcaaagtgattgccgcacgaaccttactccaaaatggtgaagttaaacaggtcagcgaggcagttaagcaagttggtatttctcgcggcacctattacaagtacaaagattatgttttcctgcctgatcatgaaatggcatcgcgaaaggcagtcatttcattaatgctccatcacgatcgcggtattttgtcagaggttttgacggtcatatcgcatgcacaggccagcatcgtgacgattaaccagaatattccaatccataattgggctagtgttgtgatctcatttgatatttcggcactgcaagggaccattgatgatttagtaaccaaacttggcgatattcgcggcgtcagtgatgttcatctgatttcggtagaataagcggcatgtttttttggaggctttatgaaaatcgcatttaaattattgctctgggtgttagtagccggagttgctttatttccggcgctattattgattttgtttgtcattggcctgagcgttgttatttcgggtgctttggcagtcagtgccgttggttttgtaatgggcactatttttgttgcattggtagggttgggcattatgattccaagtgtcctgctcattattcgatttatgactttccggacagttaatgcccgatttcagcgcggcggtgaacgcttagtccttccggtgagggttcatttaactgggcgcgcgatctaccatgctatttatgaaaattacaaagctgggcgtcgtcagggaaaacatgtttttcaagcgtggagttttggtttagagacgtattttcatgaagatcttcaagcgtatctggcagaccagattctcgcgcaacacggtccggagatggcagaggcttttgtcttagataaacgtcattcatataccattgcttattaacaaataatcgaaggtaagttcaccgttttgggatgttctcaaaaccggaaatagcatgtttaaaaaattggccttagcgtttaacaatttcagttgcgctaaggtcttttttcagctaatgggtccagtaaaacgaagcactaaaccttggtaccgttaccaatcggcatgataaaaagtgtcggatcgcttaattgggccacgtttcgtctgcacgtgggcgtcgttgaatgagccgattggttcgcggccagcgcagttcctcgaaaccgatgaattcaatggttaggcgggtctgttgccgcagtaagccgataaaaagctctaattgcgccaaatcatagttgtgcaggctgtgcaaggggatggaacgcaggcgttgatcttttggttggatgttaaaaaagaagttaaatgccggcgtgtaggtctggttgacaagtgaaatccagtaccgtgtcttccggcgccgtttaaataacggggtcaatcgttccatgataatcttgagatcgttagtcatagctattgccaccattatggcctcctacaagtgatgcgcgctgaatggcggtaccgccgtgcatggcgcttttggcgtagacgagtgctttaaagccgaatcgattgcggatcgcatcaagcgttcgttccaagtttgttgccttgatttgctgatcgatcggttcaaaaaaattgagttgttcgccggtgtccggggccaagcgggaggtgtagactgccacattacgaacgacttcgccatgccagttatcgcgaaaaatttcgcgtaaagtcgtcacgatatctgagtcgcgatttgttggcagcattcgtttagcttgtgaaaacccagtgcgaccgtctgcttggctctcagcgtatgaaaagccaattccaagtgtgatttcaccggcccgtttgcggtgatgacgcaagcgggcggccacttgttcgccgatttccttaatcacaatttcgatttcgaactgattacgataatcgcgtggcagcacttgagaattaccgatacttggctggcgcgtgacgatccgctgactaatcttggtgcgatcaatgccccatgcggtcgcaaaaagctgcgtgccaagaatgcccagctcttgttttaaggcgtacggattggcgtgagcaagttcatacatacttgtgatgcccattcgtgctagatgtgcggcggtacggtgaccgatgctccagacatccgtcatattcttgattcgccagatagtttcaggcacggttgcatatgtaatttcgccgagtaaatcggaattgtacttggcgtatacatccagtgctatcttggcctggactggattctcacccataccgacagtggtgcgtaaaccgagctgttggtgaaccgttgcctgaattaacttggcaacggcgcgtggtgtcttgccaaaaagtcgccaagtatgggttaaatcgagaatggattcgtcaatcgagtatggccataaatcttcatcggcaacgaactgacgaaaaatgtcattgatagccagattcttcttaatgtaaaggttcatacgcggaggcacgacaattaaatgtggttcattaggtaaatcgcgttgccggctgacgttactcttgagaccatacatttttttggccattggcgacgtggctaaaattaaaccgccgttcgtattttcctgttcggacatcaccacgagaacggttttgagtggatcaagtccacgctcgatgctttcaaccgatgcatagaaggacttgttgtcgatcaaaaaaatgacgcgatgcggttcatgcgaatagtcatagcgcatatcaatcacctctgtagctattatacgaacgtatgtttgcaaaggcaagttattttctgcttacgttgacaatgcacaaataaaaaatccacgctgcctggaaaaagacaccgtggatcaaaagtttattggttgaaactattaactgactaacgcatgcagccacccatatgccaggatgaagcccaagatgtaaaaccgtgcatcatggtatcaggggcaatggctgtccagccgtgggtaacgaatgctaaaacgaataaggcggtaaagattgctgcgataacactcaaagtaacgattaaaggccgccatttttccgataacatcatacttcgcctcctgctattgaatgttaacttctgccattagtatagcaccatgaacttaatagccaagttaagctgcaggcaacaccgtcgttcagcatgatcgaaacggtgaatcaatcacgctcccatttgatcttgaggttggtttcgattaagtcgccatcatcgagtgcaaatggttcaaccacgctggtgccatctggtttcgtgaatttgatgtttaaaatattatcatcgcggtaaacgacctcccaagtaccgttgcttggggtgttgttgttagttgctgtgtatgtgccatcgctattgaaattgaacgttgcccgatcgccggattcccatcggccaacaataccgctgattgagtgattatcgttgcgttttgaggtgtcagatgggtaggtgcggttggttttggtcacgccattgtcgtcatagtcatcatcatcgtcgtcatcagtgtcacgacttgtttgtgaagcctgtgacgatgaagaggcggtgttggacgaggcagctgctgcgtctaaagtgagtgcagcggcttggcctttcaggggaacgatcacgtcgcgggtgaaatctttagttgcaccgtcatgcgtaccgctaagcttaagggtatagcgtcccggaagttgattggcgatcgtgtattgaccattatgattggcagcttgcaccggcgtttgattcagcgttaacgctgcgtttttaaggttagtcttcacggttaccgcggtggttccaagcttgactttatacttcgggaaaaacaacatttcctgaccttgtttgactacctgaaccataccgctagtggacttagcccgaatcaaggtatttaaaaggctgcgataatggcgatcctcaatgagttgggccagtggtttgaggtcatcttcatgcaaaggcgttccatcgctggcaacggcaacttctgccatatcatcagcatcgccgcttgtcatttcttcggcaagctcggcaacttgccggtcttgactataataggcggcgccggctaaataggcacaaccggctattaagatgacgacaatgccgacaatccatggccagcgccgatgtgagtgcggcgtatgtcgggttggcgctggggctgctgcagttgttgatgcaggggtcgttggcggttgcggcgtggacgcttcgttttcgcttgtttgctgcgcttgcaggcgggctgaccgtaaatcaaagccgcagtttgggcaaaagtcatcgttcggtttaatcggttgcccacagttaggacagaattttaacggtgtttgcatgtatcattcctccaaagttttaatgagttgagcagcaatttgatcatggccgcgttgattagggtggaacgtatcccgggggccattggcagtgaaatccggaatgacagtgccagccggtccggtgacatcatcatgaccttgccagatggttgccaagtcaacgaccggtacctggtaggtttggcccactgctttaacaacggcatcgaatttcaagtcggcattaacgtagggcccttgatttggtgaccaggttgtcatgaggatcagttgtgccgaggtttctttttgcaacgtggtgacaatggttgtcagtgcttgttgataggcagcgagcgcagttgaggttgcgccaccgacagcgtcattggtgccaaactcaatagtgatcacatccggatgctgggcaacgagttgcggtaaagcggggacgcccaagttagtagccgtttttcccacttccgcaatgccggcttcggtgacggtttttccggttaatcgggccagctgccgggcaaaaagcgacgtaaaacgagtggcttttttatcggcaaaaaggccaacggaaagactgtcgccaaaaggagcataaaccagttgtgctttgcttttggccttcaatcgtgctaatcgagtcgggcgcggcggcgttgaagcggcgctggcctgacgactgcgagccgatgcagaggggtggcttgttgatttagcagcttgccgcgaaaccccacagccggccgctactaacaatagtaaaacacccaatcccaaccaaatctttttcatcccaatacctttcttgaatcgactgatgacatgctggttataaatagtctttagctaacaaatcgggtattgcgcgctttccaatcttctagcttgataaagacccagaaactgtaaatgccaagcgtgatgatcgatagcagcagccacttaatccaattgccaaataaaccgacagcggaaccgtaaaaatgcatccgatggccttcaatcacggtatggttgatcttccagccatataacatagtcaacgcccaaggatagcagatgcccagtgtggcgatcgtaatcaccgcaccgagaatcgcccagccaatataggccaataagccgccatcgaaaaaagaatttcgtccatttctcatttccataatcgttgcatcctccaacttctttacttaagtgtatcagagtcatcgggcaacgcaatgaatatgcgctatagtgagcgcgagccggcgcggttaggagtcggagtgtaagtggccttgggcgtgatgacccggtcttggtcattgcgcccaaggtccttacacgcagactcctgcgccggggagcgcgttatgggcataaaggagaactagtggccttgggcgtgatgacccggtcttggtcattgcgcccaaggtccttacacgcagactcctgcgccggggagcgcgttatgggcgtaaaggagaactagtggccttgggcgtggccattgcgaccaaaagccctacttacacgcaagcccttgcgccggagaacgcgttatcgtgattgtctgtctcacgcttaacgccaaagtttggtacaataggtcaaggaatttttcacttggcttttctgaaaggacgattcgttaaatggtaatggatgccgcattaaagggtatgaatgataagcaggcagaggcggtgttagccactgaaggaccggttttgattatggcaggggccggttctggcaagacgcgggttttgacccaccgaattgcttatttagttgaagaaaaaaacgttaatccatggaacattcttgccattacgtttacgaacaaggctgcgcgggaaatgcgggaacgggtaggtaaactggtcgatcctgagattgcccgcgatatttgggtttcaacgttccacgcattgtgtgttcgtattttgcggcgcgacattgacaaactcggttacaatcgggcgtttatgattgctgatccagccgaacaactcactttggttaagcacattttggccgacttcaatctggatcccaaacgttatgatcccaagtcgattcttggcgcgatttcgggtgccaaaaacgaactaatcgacccgcaaacttattcagacgagcaggccaacagcccatttaccaaaactgtggcccaagtttatgcggaatatcaaaaacgcctgcgcagtgatcaagcattggactttgatgatctcatcatgcagaccattgtgttatttgaaaaggatcccgaaacgcttggcttttatcagcgtaaattccggtatattcacgttgatgagtatcaggatacgaacgaagcccaatatcgcctcgtgcatatgctggcggaaggttatcacaatctgtgcgtggtcggggatgccgatcagagtatttacggttggcgtggcgctaatatgcaaaacattctggactttaaaaaggactaccctaaagcccaagtcattttgcttgagcagaattatcgctcaaccaagacaatcctgagtgctgccaatgatgtgattaaaaacaacttgaatcggcaggctaaaacgctatggacggaaaatgccaccggcgacaaaatcacttattatcgggctcaaagcgaaaccgatgaagccatttttgtgattcgccgcattgaagcggaaatggcagaacatcaccgcaagtacggggattttgcgattttatatcggacaaacgcccaatcccgtgcgattgaagaagcgttcgtgaagtccaacattccttataaaatggtgggcggacataaattctatgatcgtaaggaaattcgcgatgccttggcttatttccggttggtcgtcaatccagctgatgatatgagctttaaccggatcgttaatgaacctaagcgcgggattggcaatacaagtgttgctaaactggaagcctttgctaatcagcatgattggtcactcttggaagcagcggcaaatgctgagcttagtccgatttcaggcaaagcccgcggcaatctagccaaattcggtaaaatgattcaacgacttggtcagcggcggaaagatttgaacgttacggaaatgatgcaggcaattctggatgatagcggttatttagggacgttacgtgccgccaacaccttggaagccgaaacgcgagtggaaaaccttgaagaacttttgtcagtgacccaaggatttgatgcgcgctaccagccggaaaatgaagacagtgatatttttgtcgactttttagctgaattggcgctgttgtctgatcaagatgaagttgaagaagatgcccaggaagtgacgttgatgacgttacatgcggctaaagggctggaatttccagtggtctttctggtgggcatggaagaaggacttttcccgttgagtcgcgccgctatggatgaaggcgagcttgaggaagagcggcggttggcttacgtcgggatcacccgagcaaaacaaaagttatatttgaccaatgcctatgcccggatgttgtatggccagcgtcaaaataatccggcgagccgttttattgaagaaattgatcctgaattgcttgatatttccggtgctgcccagccgaaaagtgatataccgttcatcaaccgcaccgatcgcgcctttagttcgccttatagccgtcatcctgaaaccactgggacgccggtaaccgttaaaccggctccaaccactggtgccggcaagacaagctgggaagccggcgataaagtcgaacaccgtaaatggggaatcggtaccgtggtcaaagtaaccggcaccggtgacgatcaggaactagatatagcctttaaagcgatgggaattaaacggttattagctgcgtttgccccgattaaaaaagttgaagcctaatgatgcatgaaaggttgttaaccgcgtagtgaataaggaggttcgccgtgttaagtaaaccagctgctcaatttacacttgaagaagccgaagccgagattgccaagcttcgaaaacagttaaatcaatggcgcttggagtattacaccaaagacgctccaacggtcacagataatgtttatgatgatcattatcgtgacttgcaagcgttagaagccgcttttccaaaactggtgacgcctgattcaccgacgcagcaagttggcgatgtcattaattcggattttgccaaagttcagcacccgattcccatgctgtcaatgggcgatgtcttttcatttgaagaacttagcgaatgggatgcgcggatgcaggctaatgtggggcatgcggttgattacaatgttgaattgaagattgacggccttgctttgtcgcttatttatgaaaatggccgcttagtgcaaggctccactcgtggtgacggtaatgtcggcgaagatgtgacaaagaatgttttaaccattgcttcggtgcctaagaccttgaagcggccactatcgcttgaagtgcgcggtgagtgctatatgcctaaagctgcgtttgccaaattaaacgcacgcaaggaggcagatggggacacgccatttgccaacccgcgtaatgctgcggccggctcgctacgacagctcaatcctaaaatcactgccggacgggaattggacacgtttatttatacgttaattgacgccgatcggtttaatgtcaaaacccagcatgaggcgatcgcatttatgcaggatcttgggttcacaaccaatccaagttccgaagtggctagcgatatgcaagcgattgatgcctatatcacgaaatacaccagcgatcgggatgctttgccgtatggaattgatgggattgtgctaaaggtcaatgacttggctttgcaggcccaactcggaaacaccgtcaaagtaccgcggtgggaaattgcctataagtttcccccggaagaagccaaaacggtgattcacgatatcgtgtggacagtgggtcgaactggggttgtgacgccgactgcggtgatggatccggttcagttggctgggacaacagtcgcacgggcaacgttgcacaatgccgacatgattcgggataaggatatccgcatcggcgacactgtcatgttgcataaagccggcgatattatcccggaagtttcacgcgtcctggttaaaaaacggccagccaataccccaccagcgccgattccggaaaaatgcccatcatgcggccaaaaactggttcaccttgatgatgaagtggcgttacgctgcatcaatccgatgtgcccggcgcaagtacaagaacagttgacccattttgcctcgcgtaatgcaatgaatattgatggattaggtccgaaaatcattgctcaactccaggctaagaagctcgtgacggatgtcgccgatctttatcgactcacggccactgacttggaaaagttggataagttcaaagaaaaatcaattaataatttgttaaatgcgattaataatagtcggcaaaattctgtcgaacgcctaatctttgggttgggcattcgccatgtcggtggcaaagcggcacgtattctggccgagcattttggcagtttggatgagctcatggcagccgaccaagaccaagttgcggcaattccgaatatcgggccaaccattgctgaagcggttgtcacctattttaaaacggatacggtgaagaaattggttgaacaattgcgctctgccggtgtcaacctgcgttataccggtccaacccgtccggcagtaagcgatagttttgtttctggcaagaccgtggtgatcaccggcaagtttgccgagttctcccgtccggaattgacaaaacgcttagagcagttgggtgcaaaagtgactggttcagtgtcgaagaaaaccgatctcgtcattgccggggatgcagctggtagcaaactgaccaaagcacaggatttgaatgttccaattatggatgagacagcgttgttgacgaacttgaagaattgaggaacttcatcaatgaagaaattttttacgttaaccttactgacaggcgccattgtgctgttggcggcgtgcggcaagctaaatcttgacagcggcagcagtagcaccggtggaaccaaaaccggcagctaccaaacgactggaacggttgataatagtatgtaccaaggcgtgatcaagaatggccgctatcagaccagcagtgcacgtggtttgatgctgcaacaaaacgatcaaggcgaaaatacttttaacatcaagagtatggaaagtggcttggagagtttggccaaagcccaattttcaacggataaatattcgtttgaagaagggcagttattgagcacggcaacagcaagaagttggcttaagcgggagtcaaagagcaatcccgatggcttaaatccggttgataacgggaagaaagatcctgatacccgtaatccgatgtatctacagcagattctggaacaggacttcatggtgcaagacggcaacagcatgaaactaggcgggattgcgattgcgcttggcatgaatcaggtcgattactacaccaagaccgaatatggtgcgcaatatcaaaccgaaatttccgaagcaacgctgaagaaacaaggtgaggccatggcagcaaaagttgtcgcgcgactacgcaaaatggaaaaggtgccgagtgatgtaccgattttggtaggtatttacaaaaacgccgaacaagatagtctggttggcggcgtttatgtcgaacacgcgaccagcaagagtggaacggatctcggttcctggaagaaacttaatcagcaaaatgaaattctgccggttgtcagtgaccataaagcgattaacagtacggttgccaatgacttttcgagttttacaaatcaggtaaaaggcttcttcccgactttagcagggatcacggctcaggcgcattatgaagatggcaatttaagcggcatgaagattaccgttaacactcagttctatggcttgacggaaatccaaagtttcacgcagtacatttcaactgccgccaataagtatttgccatccggtgtgccaattgaaattaccattcaaagtacccaaggcatccaggcatttgtctcgcgaagttctggggacaaaggcttttatacgcatgtatttggaagttattaaaggaaactatggtaaactacgaatgataatgaaaatgaaagcggggatagcatgatttcaaaagacagtgtggcacacgtggccagtctggctaagctgcaattttccgaagccgatttggagaagtataccggtcagctttctgaaattttggatatggttgaacaattggaaagtgtttcaaccaaggatgtaccagtcaccacccaaagcattcatcttgagaacgtgatgcgtccggatgttgctaagccgagcgaaccagtcgccgaattgcttaagaacgttccgactaaaaaaggaacctatattcaagtgccggcgattattgacaaggaggaggactagggcgtggattattttaaaacgaatcttgatcaacttcatgaacagttacgttctggcaagctgaccagtcgccagttggttgatgagacgctggccggtatcgataaaatcgatccggaagtggccgctttccttgccataaatgcggacggtgccaagaagcaggcagccgtaattgacgaagccggtattgccgatgatcagccgttatccggggtgccgatcgcgattaaagataacatcgtgactaaaggcgttgtgacaaccgccgcttcgaaaattctggaaaactttaatcccatttatgatgcaacggtgatgcagaagctggccgctgccggtgcgattaatgtgggtaaaaccaatctggatgaatttgcgatggggtcttcaactgaaaactctgctttcaaaacgactaaaaatgcttgggatcacagccgcgttcccggtggctcttcaggtggatcagcagcggctgtggcggccggtgaagtgattgccgctttgggtagtgacacgggcggttcgattcgccagcctgctgctttcaacggcattgtcggctttaaaccaacgtatggtcgggtttcccggtgggggctcatcgcgtttagttccagtctggatcagattggaactttgacgcgcggggttaaagatgccgctcagattctgaatgtgattgccggacatgatgaacgcgacagcaccactgccgatacgccggtaccagacttcacggccaaaatcggacaatcgatcaaaggcatgaagattgcgttgcctaaagaatatctaggtgaaggggttgaccctgaagtggcagctaaaatcaaagctgcagctaagcaacttgaagctttaggcgcaaccgtgtcagaagtttccttgccacacacccaatatgccgtaccgtcttattacatcatcgccagttccgaagccagttccaacttacaacgttttgacgggattcgttacggcttccgcgccaaagatgtccacaacattgaagatgtctatgttcgttcccgttccgaaggctttggacccgaagtaaagcggcggatcatgttaggaaccttcagcttgtccgctggtttttatgacgcgtacttcaaaaaagccggtcaggtccgcacgttaatcactcgggattttgaagctgtcttcgaggattatgatttaatcattggaccgaccacgccaactgttgccttcaagattggggaaaaagtaaccgatccggttaccatgtacatgaatgatattttgacgatcccggtcaacttagctggcttaccggctgcctctgttccggctggatttgttgatggtttgcctgtgggcttgcaactgattggcaaacatttcgatgaaagtacgatcttccaagttgccgcagcttttgaagcgcaaaacgactacttagcacagatcccgggaggcaagtaagatgaattttgaaacgacaatcgggcttgaagtccacgttgaattaaaaaccaaatccaaaatgttctcaccagcgccagtcacttacgggcaagagccgaataccgagaccaatgtcattgactggggctttccgggcgttttgccaagcatcaaccgcggtgcataccaacttggcatcatgttggccttagcgttgcatgcagatatcactcggcagacgcattttgaccgtaaaaactacttctatccggataaccccaaagcttaccaaattacgcaaagtgaaaaaccacttggcactaacggttgggttgaaattgaagtcggcggtaagaagaaaaaggtcggcatcgcggaactacacgttgaagaagatgccggcaagaaccaacatgaagacgatggttactcttatgtcgacttaaaccggcaaggcacgccgttggttgaaatcgtctccaagccggatatcacaagcccggaagaagcatacgcctaccttgaaaccctgcgccaaatcgtgcagtttaccggcgcttctgatgtcaagatggaagaaggctccatgcgggtcgacaccaacctatccgttcgcccaatcggacaaaagcattttggaacgaaaaccgaaattaaaaatttaaactcctttgtccatgttcgtgatggtttggcatatgaagaaaagcgccagcaagcagttttacttagcggcggtgaagtacgtcaggaaacgcggcgttgggatccggatactaaagagaccattttgatgcgggttaaagaaggcgccgatgactatcgctatttcccggaaccggatttaccgccagttacggtttcccagcagtggattgatgaagtgcaggcaacgttgccacagccaccggcagaacggcgtgagcactacattaaggactggggcattccggcctatgatgctggcgtcttgacgcaaaccaaggaaatgtctgacttcttcgaggccaccgttgcccaaggtgcggacgccaagcaagcgtctaactggttaatgggtgaagtttccggttacctcaatgccaaacacacggagcttggtgacgttgcgctgacaccggaacacttagccggcatgatcaaactcattggcgatggcacgatttccagtaaaatggctaagaaggtcttcaaggaaatcattcagcatgacaccgatccggatcagtgggttcacgaaaaagggctgatccagctttccgatccggctaagttgaccccgatcattaccacggtattggacaacaatcagcaaagtatcgatgactttaaagccgggaaagatcgtgcaattggcttcctggtcgggcagatcatgaagcaaacccatggtcaggcgaaccctaaagttgtcaatcagattttgatgacagaaatcaaaaagcgttaaaggcatttattgaaaattgtggtacggtattcattgaccacatacgattgcaaccgattgacggcggtccgtggtacaccattgggccgccgtttttcgggtattggtcaggttaagcatgcttagaatgtgatgaccttagaccacgtgaaaagaacccgcaagtcagttggatttggaattggcttgtgcattgaaggagcagagagtcatgagaaaacgggcgcgcttgatttacaacccgacatccgggaacgaaggattaaaacgtttcgttcctgacattttaaacatcatggaacaggcaggctatgaaagttcgacctttcaaacaacgccaaagcctttttccgcgcgtgaagaagcaaagcgggcaaccgaagccggctttgagctcattgtggcagcaggcggcgatgggacgatcaatgaagttgtcaatgggattgcgccagccaaaaaacggcctaaaatggcgatcatccctgccggtacaacgaatgattatgcgcgggcactgcggatttcccgtgatgatccggttgaagcggcacgggttattttaaaagggcaaactttggcgatggacatcgggcaggcgaaccatcattattttatgaacatcgcagcaggtggtttgttaagcgaattgacttattcggtcccatccgaagtcaagtccatttttgggtattttgcttatgtcattaagggcgccgaaatgttaccagcggtccggacgatgccgatgaagcttgaatatgatggtggtgtctatgacgggccagccagcatgttctttcttggtttgaccaattcggtgggtgggtttgaacaaattgtgccggatgccgagttgggtgacggtaagttctcgctgattattgtcaagactgccaacatggccaatttgttgaaattgatggcgcttgtcttcaacggtggacgccatgttgacgatcccaatattgtctataccaagaccaaaaagttgaaagtcaaaaccagcggccaagacacgcttaagatcaacctggatggcgaatatggcggcgatgcaccgatgacttttgttaatttaaagcaacatatcgcgatgtatgctaatgtagacgagatcccaaccaagaatttagggacggatgcccagaagcaaagagactacatggcagaagtcgaatcgatctcccaccgcgacattgatggcgatggtcaaatcggcgcacaagatgaaaaggatgactaatttggcccaaccagctgttaccaagaatcaggatctggaagttacgattgaggatctcacttatgaaggcatgggcgttgcgaaagtcgcgggttttccgctatttatcgaagatgcgctacctggcgaaaagatgcaggtacatgtgcttaagacccagaagcaatacggttttgccaaagtggtgaagcgactgaccgactcgcccgatcgcgtggccggcgctgatagtacttacattcgcaccgggattgccccgttgtcgattttggcttatccagcacaattaaaattcaaacaacatcagatccaggaactctataaaaaggcccacttggcgatcaaagtgttgccgacaatcggaatgaagcatccactaggttatcgcaataaagcgcaagtgccagtgcggttggttcgtggcgaacttcagactggtttttataaaaaacacagccatgacttagtgccgattgaggactttctgattcagaatcctaaaatcgatcaggcaatcgttgtggttcgcgacttgttacgtaaataccgggtgccgccttatgatgaacgtacgaaccgcggcgtgattcgtaatatcatggtgcggcgtgggcgggcaacgcaccagatgatgatcgtgttggtggcgcgcacatggcaagtaccgcatctgaatgatattgtcaaagaaatcacgttggctcttccggaagtcaccagtgtggtggttaacctgaatgataaacgtaccaatgtgattctcgggcgtaagtcaaaaacaatttacggtcgcgactatcttttagacaaactattaggtagtgagtttcagatttcgccagtcagtttttatcaggttaatccgattcaaactgaggtgctttatacgaaagccattgaagcagcggggttaaccggtaaagaaaccgtgattgatgcgtattctggcattgggacgatttccttaaccatggcgcggcacgcaaaacaggtctatggtgtcgaagtcgttgagtcggcagtgcatgatgccgaggcaaatgcggcgcgtaatcacatcaaaaatgtgacgtttgaggttggtaaagcagaggacgtcatgcagaagtggaaggacgcggatctacctgtcgatgtcctaatggtggatccgccgcgcaaaggcttggataaaacctttattgacgcggtggggtatatgaagccgccaaagatcgtctacatttcctgtaatcccgctaccctagcgcgtgacttgcagttgctggcagcgtttggttatacagccaaagaaactcagccggtggatatgtttccgcagacgcagcatattgaaagtgtgacattactcgaaagtatgagagaataaccaacaagtgttgatataacagtggctaaggatgattttaagtataaaaagctcatatgataatcatgatcagtataattttacgtttccttttttctttagtatacgatgaattagaatagtactttgagtgggttagcatttcatttaattattccagaaaatggatgcgatagaagtcacgttaaatactgatacagcaagtgtagatcgaagttattaaaccgaggttgctgaaaagtcccaaatcgtaaatttgataatcccaaatcccaattatctccaataatcgtccgtccagtggggaacaccactcgcaaatcgatctgttatcaaggtatttggagggcccgtttttacgagatttagtttttcagcagcctctattaaatcagtagatttttcgcctaataataactaaacaaaaatggctataacaagatacatcacattgaaggaaagaaaaccacaatatataactaacgaaaagaagatggattaatcataatattatcctaaaaaataatacggagcatcaataataattgattctattaattggcaagagtttaagaacttgcttgcgcaaaaaggcgcggatgttgctactgatgttttgaggagggtttcacagagccatagtgtgcaatcttttgaaaatccgtaaagccatacgacttaattcgaaataggagaaagttaatgcaaactgataatgaaaagtacaatgaaaaggcacagcctaatactgcctttatgaatgaactgaagaataaactgccagagttttttacgaaggatggctcttttgatttggaaaaatttgtgggacagttaaaagacaagaatgttgatgaactcagtgaagggtatcagctagtttttattggtaagaactatgcacgtcgtcaggccggtgaaatgccaaggacggtgattgttcccgatgaacagcaaaataaaaatgagggtaagaacagtaaaaaccttttttttactggcgacaatcttgaggtactgcggcatttgcagaacaattaccagaataagattgacgtcatatatatcgatccaccatataatactggtagtgatggctttgtttacccggattcttttgaatatagtgatgatcaattggaaagaatgtttgatattgacgatgatcaggtggaacggttgaaaagtatccagggtaaatctagtcattcagcctggctgacctttatgctcccaaggttaatactcgctaaaggtttgttatctgatagcggagtaatttatgtttcgattgatgataatgagcaagcacagttaaagttgttatgtgatgacatattcggcgaaattaattttctggctgatgttatttggaagcatacgcagcaaagtaagaacgatgagcctttctttgctagaatgtataaccatacattggcttatgctaagaacataaataaattgaacccgttctttttaaagagaacatcaaaggataatataaactattcaaatccagacaacgactcaaatggagcgtggagagcaggagatgttaggagcccaaacctaagggcaacattacgatataatattactgctcccaatggaaagaccatttttccacctaaaaatgggtggagatggtctaaagatacaattaatgaaaaaatcaaatctggagaagttgtttttaagcctgataattctggaatcatcagaaaaatttatttatcaagtcaaaagggaagaactcccgaaaatatttgggcgaatggagaagccggaactactagaagtgccacttctttattgaaagccttgtttgatggtgtttctccttttgggacacccaagccggtggaattaattaagagatttttagagttacaaaatgacgatgacgctactgtacttgatttttttgcagggtcttcaacaaccgctgaagctgttatgcaattaaatgtcgaagacggcggtcaccgaaagttcatcatggcccaacttcctgagaagacttaccacatcaataaaaatggtaaggaggtccctaccaagggtggcaaagcagcatatgaatctggctttaaatctattgacgaagtttcccgtgagcgcattcgtcgtgctgccaagaaaattagggaagataacgagctgaccttgccagaagactttgatggtagttttaaacactatcgggtcgttgaacctgttaaacagacactagaagaaataggtggattcgatccaaacaacctcaatctttttactgacatggttgatagcttttcaagtgagagtttaggtgtggctggagatgcatctggtacaaagactattttgacgacttggctggcaaaagatggttatccctttgatgcctgtgttcagggcgtaaattttggtaattatacagcatatattattgatgataaccgtctttatttgattgaggaaaactggggtgcaaaacagactaaagaattgctgaatcagcttggtactcatcatttagaagtgcaaagcgtcgttatctttggatactcctttaaactagccgcattgcacgaattagagattggtttgaagcagttagacaacaaagtcactttaatcaagaggtactaatgttatgaagattaaactagaaactttgcaacaccaaactgatgctcttacggccattaataaggctttcccaggcttagataccacgagcaatgatccaaatgctgactatatctatgccaatcctttgattaaatatcggtataacgataaagcaaatatcgacattaagatggagactggaactggtaaaacctatgtttacactagaatgatgtatgaccttcaccaaaagtatggattgtttaagtttgttattgctgtgcctagtcccagcattaaggaaggtacacgtagttttataagtagtgattacgcaaaacagcatttcagcgaattttatgagaatacccgagttcagctaaatgtgattaacgcgggtgattttgttatacgttcggggcgacgcaacttccctgctcaactatctgaatttgtggaagcaaccaggcaaaatactaaccaaattgaagtattgctggttaaccaagggatgttgcattccaagtccatgcacaatgatgactacgaccaaactttattaggaggtgaaacatctcctattagggctattgctgcaactcgaccagtagtgatcattgatgaaccacaacgctttccacgaggcaagaagttttatgacgatattgaagatatgaagccgcaattaattgtacgtttcggtgctacctttccagaaaccacaaccggtcgcggtaaaaacaaagtcaccaaagtcgattattttcgaggcgagccacaatttaacctcaatgccgtagatagttttaaccaaggcttggttaaaggaatcgatattgattatcctgatatgtcgaaagagcaagccaataacttgtacaaggttaaacaagttaaggctaaagaattaattctgttcaaagatggcaaggactacttattaaatgtaggtgaaagcttggctgatgtggactctggttttgaaggcaatatcacctatgtcggtggaactgatcgtgaactttccaatggtcttgccgtatcaaaagatatgaaactgatccctgggacttttgcaaaaaattaccaggatgaaatactctcccaagcaatcgattgtcactttaaggctgaaagggaaaactttttgcgcttgaattcgggaagtcacacgccaaagattaagaccctttccctattctttattgatagtatttctagtttccgtggcgaaaacagcagcaaaggctggctagcaaagcactttgaggaaattctaaagaaaaaactcacaaaactaattgatcgatacgaattggccattgatgatcgcgaaaaagaatatcgttctttcttgcaggccaccctaaagagcctgcaatcagaacatcaagacgtttatgctggttactttagtgaagaccgaggtagctcgaacgcagatatccaggccgaagttgaagatattttaagcaacaaggaaaaactacttagttttaaagacgaagacggtaactggttaacccggcgtttcctcttttctaagtggaccttacgtgaaggttgggataatccaaatgtttttacgattgctaaattacgaacttcgggttctgagattagtaagattcaggaagttggccgtggcttgcggctgccggtagatgaaacggggcatcgcttaaatcaggatgaatggcagagccgactgtccttcttgattggttatgatgaacgggatttcgctcagaaattggtgggtgaaatcaatgaagattccccagtgaagttgaacaaagaagagttgactgatgacatgatcaagttaatcgttaaagctaaacagaaaacagatcctaagtttgatgaggatcagctgcttgatgatttagatagacataatgtgattagtcgttctaataagtttaaacaagatgttaatctcgatggtgaggccatgactggctatgatgcattatgccgcctctacccagaattagaacaacaaacgaaaattgctaagggcaaggttcgagataagtattctaaagatagcacaactgttaaattgcggaagaaaaattggttacagttgaagaacctctggttacaacttgctaaacgacaaatggttaagtttgatccctcagttaatcgggatgccgaagctgttgcacgcgatgtctttaatgataatgacaataaaatctttgttttgcaacgtcctcaagtggtgcaccaagaggttgtcactgataaaaacattgcttcagttcaagaaactcagttagattataataatgaatatctaacgatgaattatggtaagtttctcaagggcttagctaagcagactgatttgcctcttaaccttctcaataacctgatgattaagtctatcaggcgcctgcaaaacaacactaactatattaatgaaaagacgttagaaaaccttgttcgcagctttaacaatcagtttaacgaaagaattaagacctcttatagttatgaaccactagactttgcagcatctacatccatttataatgctgagaagaaagagtttgttaactcagtgcctgctagtgtacttggcgtttatcaatctaattcaacttctgatcctacttatttatatgatcgcccaccgcttcgttatgatagtgccgatccagaattaaagattttgcaacgctcatatggtccgaagatcagtgtgttcggtaaattacccaagaaggccatcaagatccctcgctttgacagtggaacgacgacacctgactttatctttaagattgagcatggtgctaaaccaatctatctggtaattgaaacaaaagctgaaaatatgcgcttgggtgatgaagagatccgtattatccaaaaaaagtactttgatcaccttaaagagtcaggtgtttactatcgaatggctacgagtgaacaggaggttcatgacttaatcaataaattgacaaacggggagttggactaggatactgtcgctaattgtattagtcatagaagagaaattagaaaaaatcggtgtttaacctaaactccaaactgagtgaagccagccactggatgtcaccactgccgcacttatccttttttctcacgaatgttgccaccatacagtaaggtagagacgagtaatgaatttaccctagatgtcgacacttaatttgatattcagtgaacaatatcgatactgtggcatttgtttgctagtttttgcgtatatcgcatatattgaagaacaggtaacccaccgaaacttttatccggtagaagcttgggaaaagaatgcgttctttctggatattgtttagtttgttcaacagacaagtcccctatgtggtgtctttttatttactttgattaaactttcttaaccttggattgcaagtaactagtattcgaggaatgttgtgattaattcagaagaagtacctaaatagtggatggtgaaaaactataaaagtactttaataataggatttaccaatagttcggcgtataataagtgcaacccttatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagtttccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcgggttacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcagcctaaatcaccaggcactaaatacggcgatagtgaactgccacaacccaaaatctctaatatactttatgtacgcgcttaccatagaagtgttcaaagtatattgggggtttttgctataacattgttggcactcgattaacctcgatgttcgagtctgacaatagctacggcactagtggacaaagctgccttcggatactggttttacccgcggttttgctgcggcttgacggcagaatcatgataaccgcctaaatatttgctcattcaagttgctatgtttggctggtttcgattatgatcagtatcagtgacacgaaatgggggagaatggtgcagcacaagactttggcaatgaagtggttgtttttgggatcactaatcaccaataccggcattagtttgatttggccgttaacaacgatatatatgcatgaatatttgggtgaatcactcacagtggcgggaatcgtcctttttttgaattcaatgtttatggttattggcaacagtctcgggggcgggttatttgaccactggcagccgtatgggacggcgctggcaggcatttgtctgaatcttggtgcaaccggtttgttgatctttttccatggctggccggcgtatccgttactactggttatttccggttttggcagtgggatcacatccacggcgattaattcttatgcgacgcggattcgcgacaaacgcccgagtgtggtgtttaatatcttgtatttcacatcaaatctaggacttgtgattggcacgctgattgtcgggtttgtcttgccttatgggattgccatggtgtttgcattggccgcgctgctatttgcggtctttttagtggtcgcgatctggcattatcgtattgaaaaagaaactccgacagccgccgaacagccagtcgcccgcggcagtcgcaatccggcgcgcccacggttgatcatgctgatagtgacgttgtttgtgacgtggttaatgtatgaacagtggcaaagcaatatttccgcctttatgttaagcgaaggcctcacagtcaaggactacagctttttgtggacagttaatgcactgctgattgttttgttccagccggttttgacagcgtttgatcactggttgttgcagcatatccggttgcggttgattggtggttttgtcttatttgccggttcttttttgattttgctaaatggttccgggcaatatctgacatttattatcgccatggtggttttgactttaggcgaaattctggcattgccggcagtttcaacttatgtcactttgtttacgccgcttgcacaacaagggcattatcaaggtttgattcaaggctttgcgtcagcgggccgagcactggggccattgttaggtgcaatggtgattgaaggtacgcaaagttatcggctgttgtttgtcggtgccaccggtttgattttattagcggtgttgggctttgcctttacggttcgcgaaagtattccggcactgaatgatccgttacacccagcggctcattaaccgccaaatgatgcaaattcagttttaggtttcatgcaataggcacgtgcaaaggcacagggaaggggaatttttcttgcactatcggttgattctgagtgatattgatggcacactgcttaattcaaaacacgagctgactgtcggcgttaaacaagcgattcagcattatgttgctgcgggcgggacttttgtacttgcttcggcgcggccgcctttagccatgaccgcgcttgcgcaacaaatggggttggcggtgccgcttgtcagtcttaatggtgcggtcattgctcagccaaccgatgataagaagctaaaagtgttggcaacgacgccttggccagcaggaattgcagccaaagtttataccgcattatctagcttaacgctgagcttgaatgtgttcagtgacacgcattggtatgtcgctgatacgagtcagtggacccggcaagaagcagcgatcaccggttttgcaccggaaacagttccgattgaaacagggttagcaaacggtctgccagtgcacaaacttttatgtatgggcgagcctgacatgatcgatcgcactgaacaaatcgttttagcccatccggaatggcagttggttgccagtcggtcgaaggcaacttatctggaaattgtccggcaaggagtgtcgaaagaggcggcgttaaaaacgctcagtcatttattcgacattccaatggcggcaacgatggcactcggcgatggtgaaaatgacctgccaatgttgcaagcagccggcctaggggtgaccttggaaaatgctttgcctcaggtgttagatgtcattaaaacagttgtacctgataatgatcatgatggggcagcagtcgccatcaagcagtatgcaatgggtgaaggttaataaaaaagcgagtcgaattcttggtgatggaagtcgactcgctttttattttaaccaaaatagttttatttaaacctaatcttttaagtcagtaatcgcctgttccaactcctgcttctgagctgtagagatttccggatattttagcggcaaagcggtgacttcgcggttgatgatttgggacacaaccagtcgggaataccacttatcgtctgacggaatgacgtaccaaggatttgttttggtggcggtgtgttgaatggcctcttgataagcttgctggtaatcatcccaaaagcggcgttcgtgaatatccgccaatgagaacttccaattcttttcgggaatttcgattcgttttaagaagcgatttttttgttcgtccttggaaatgtgtaagaagaacttgagcagcaagatgccattgcggtgcgcataggtttccagcgccttgatatcgttgaaacgtttggcccataaatcatcatggacatcagcaacggtgtcaattcctggtaggttttcttttaatagcaactcgggatgaactcggtcgaccagcacttcttcataatgggagcgattgaacaccgtcagttcgccaccagccgggaacgcgttgtggatgcgccataaaaagtcatggcttagttcaagctcagtcggtaccttaaacgacaccactgaggttccctgcggattgacgccggacatgacgtgttcaatcatgctgtctttgccggctgcatccatcccttgaaaaataatcaagacgctgtattgtttctgcgccgccaagtgttgctgaactttagagagcaccttgatgttatgatcaatgtctgctttgatctgctcttttttattttgaaaatgttctggcggtgcggtcgcaaatgcttgaatgttaaaggtgccagcaccgtcaaaacgatatttttccaatgtcatcttatcaccctcgatttatgcttagtttcaacatagtagttacgcctaggatgtgcaagcaattgacgccttggcggattaaatctatgctgagattacgacatgaaaacggaggcaattgcatgacattaccaagaattcaagatgatttgtacctggccgtcaatggcgaatggcaagccaagacgccgattccacctgacaaaagtgttgtgagtgcggatagtaatctgaccgatgatattcgccaaaaactagtggctgacttaagcacgatgacgaaaacagccaaaactttgccgctccagtatgcagcgcggttgtttgccaaagccaatgaccaaacccgccgtcagcagctaggcattgagccagttcgtgaccggataagctttttgatgacgctcacgacgcttgatcaatttcgcagtgctatgcccaaactggttgctgaccaatacgtcttaccgatcagtccctacgttgatgctgatatgcacgatgctgagcataatatcctgaatcttggcgggccagacacgattttacctgatgcggcgatgtaccaacatgaagatgccgaaaatgcggcggatctggcagcgtggtcgcagatggcagctgccatgctggctgcggtgggattcagtcagactgatcaaacagtatatgttgaagcggctaaacgatttgatcggcgtttggctgattatgtgccagcaaatgttgacttagcggtagatagcacgtatgacaatccattgagctggcaggcgtttgaagatgcggccggttatttggggattccacaagcctttgcaacctacatgccgcaaacaccggcgaaagtcaatgcggttgtaccggcttatcttccgcacttaagcaaactattgacgccggacaattattcagaatggcacgcatggatggtgattaacgaattgctaacctgcgccacttacctcagtgatgatttacgtcaattggccggacagtatgatcggtttttggcgggtcaacctgaggcgttatcgtggacgaaacacgcttttgggattgccaacgagtattttgacgatgtgattggtcagtattatggtcaaacctactttggtgccgatgctaaggcagatgtgacggccatggttaagcagattcttgcgcaataccgcgtacagctagaaaacaacacttggctgagtccggctacgaagcaaaaggcgatgcgcaagttagccacgatgcaagtcaaaatggggtatccggagcgactcttttccttgtatgatcacttgagcgtggatgctgacgatgatttgttaacggcaattctgaaacttagcgcacagacgcaggccttttggtttaaacaggtaggccagccggtggatcggaatcaatggaatatgccgggacacttggtgaatgccagttatgatccgctgaaaaatgacatcacttttcccgctggtatcttgcagccgccgtattactcactcaaatggacccgggcggaaaacctcggagggacaggcgcaacgatcggtcatgaaatctcgcattcgtttgataataacggggcgctgtatgatgaatatggtaatttgcataactggtggacgccagcggataagcaggcatttgatcaactggtaaaagcgatgtcggcacagtttgatggccgtgactatgaaggggtcaaggtcaacggcaccctgaccgttagtgaaaacatggcagataacgccggcatggatgtggcgttggcattactaggcgatcagccggatgttaaggacttacaggcattcttcatcacttacgctcgttcatgggccaccaaaatgcgaccggagcgggctaaaactgttttgcggcaagatgttcatgcgccggctaccttacgcgtgaatgtgccggtgcaaaactttcctgcatggtaccaagcgtttaatgttcagccacaagatggcatgtatcggcaaccacagcagcggctgacgatttggaatcggtgatatttaaataaaagagttttatgtgaacctttttcgagaaccgcgagatcaactgtatgtcacactgttcatggggaagcgtaagcaaaaaggcaacgattgccatgtcagacaatcgttgccttttttcaatcttgggacaggtcgtggtaataatgcagccagccggtttcacgttcaccgatctgatcatacaaatgttgagcgccaagattgctagtacgagtctgccaacttgcgccgctgtatccgtgcgcttttgccaggtcgaacgctgcgatcatgagttgacgcgccaacccgtgccgacgaaactttggtgccacgtagacgtcattgataataagcagtggtttcagcgctcgggtttcaaagctgcggtataaaatcgcaaatccggctaattcttgatcaacggtggcgaccaataagtgaccaagactggtatcggagcacaggcggtcaaggtgaacagccattgcctgtgagtcaatggtcagcggcactgggctatcatgatagtaaccttgaacaagcggtaataagagtgggatatcggttgtcactgcagggcggactgccataataaaatcctccttgattgaagtgagcgtgaaccggcgcgcttagaagtcggagtgtaagtggcctcagtcgtgatggccgggctttggccattgcgactgaggtccttatacgcagacttctgcgccagtgaacgcgttatggagcgtgagttgacgcggctagggatcggagtgtaagtggcccaggtttgaccattgcgatcaagacccttacatgcagattcttgcgtcaaacaacgcgttatgaaacacgtgatgaagccttaacgattgtgaaaataagcactgcacacaagttcatctgcaactattttacctgcaacaacagcaaaaagctgctaatgaagtctgagcttaaaatttcttgaaagtctaatttatttccgctccgaagtcgccattgaaaagaccgccacacagccaaagcctgtgtgactggcaatggttggaccgatgttaccaatctgcagcggcgtttgcggggaggcgtcatgcaggcgctctttgacaaagtttgctgcctcaaaatcgccggatgttgatatgataatgcgatgttgcggattttcctgaatggcttttaaagtctcgttggctaagtcaatcagcgagcgtttgcgggcgcgaaccttgcgcacaacgcgtaatttaccggccgtatcaacgtccatcaccggtttgatgtttaacatcgttcccaatgccgcggaagtacgcgacacgcggccaccgtggtacagaaagtccaatttatcgaccgtaaaccacatccggtagtccagtcggtgcgctgtgagccagtgcgccagttcatcgattggcatgccagcatcgcgtttttcaatggcatccagtaccaattgtccttcaccagcacacgcagctagggtatcaaccaagtaaatctgcgcatctggatacttttccagtaacatggcacgcgcttgagtcgccgaattgaaagtgccgcttaaaccgctggaaaagccaacatataagatgggcgtgtttgctttgacatacggtgtgaaaaagtcaacgaactggccgacatttacctgtgtcgttgtgggcatcacattttgcttcagttgctcgtaaaatgcattgatatcgtaatggtcttctccaagatcgtcttcataatctgtgccgttgacggtgaagtgcatggagacaaattcaacttgatgatcatgcaaagtctggtagggtaagtcgcaacaagaatcggttaacagttgatacatggtttcacctcaaaatatccgcactaaaacggatctgttttcatcaatactacgctgtttggggttgttctgaaagctaagggcggatggcgtaccataaagtcgttgaacgataccagccctacctgatgtgatgcgcagtagcggaacttaaaaagtcgaattgcattgtgccattcgactttttaaccttacttttccttggtggatgctgacggttgtttttgattgaacagggttcccacagcaggaagactgcctaatgaatcaatcgcggtacttggtagaaccactgtgttggcagtgcctttagctaaagcttcgagtgcctcaacatttttatatttcaaatataaatcgccattgtcaatcaagccggcattgatcgagttaatttgatccttaaccgccgctgcaatcagccgttgactttctgcgtggccttgtgcttgaaggatttgcgtttgcttattggcctcggcttcaagaatcgcggcctgcttttcaccttcagctttagcgatcgctgcttgcttatgaccttcagcttccatgatgttggcttccttttcccgtgaagcgcgcaacagtttgttcatggagtcttgaatggtagcatcgacttgaatggaatcaatgttgacccgatcaacattcaagccgtagccagcggtggtttcggcgatttgctgaaacaaggtttggttaatggtttcggtgccgttcaagacgtcattcaaatccatattgccgataatcccacgcagattagcccgcgtatcttgaaccatggacaacacggaatccttgttttgataaacataggcgttaacatcagtgatatgatatttcaacgtttcggaaatacggacgacaacgttatcttttgtaatcacttcctgttcattgaccttcagcggaatctgcttcatgttgacgatttcggtgatccgatagatgaatggtggcaccacatgaaaacctggctccaacgttgctacatatttccccaaccgttcgacaatgccaacttcaccggtatggataatggcaacgctggtgaaaagaattgcgatgacgatgactaaaacaatgactagaacagaaatcaggataatattcatgcgaaagccccccgtgtgagcgagtcaattacgactcaatctcaataatgtaagcgatgttctggtttgacgacgctaagataaagcggcgagaccgcattgacaacgacagtatcgccagccgcagcgtcatcagtgacccggtaatgataatgaatgccataaagcgtaatctcaccctcttgatacgatgttggtaagacaaacgttgtccctaaaaggcgatcgtcaagcatgggcgctactcctttctggtcatcttcattgattgctttgttacttgacgctagcaatgattatcacaagccaattttaaagcagggttgaatgaaagacaattgggacggcttagaaagaaaaaattatgctcgttattctatgctggaactttagtacagtctatgcttcattccgtaattagttcaaacactttttattgtggaagactttgttacaataagaccattgtggcacgaatggttggaacggttaatgtaggtgtgtgtcgttgcctgcgctggctcacgctccataacgcgttccccagcgcagggatcggagtgtaaggacctttgccgcaatggccaaagcccggccatcacgtctaaggccgcttacactccgatccctaaccgcgctggctcacgctcactttattttagaaaggatgttgttgatgcgtagacgacgagttatttatgcaaatacttatcggcatcggcggcggctgtggtttttgctgattagcgcaggagtggtcacggccttagtaatcggctggtggctgctgcgtaatccacggccggatccgaccgcttatccagtgttgggcgttcgccttgatcaaaccgatggcgttcaggattttgatcgtttacgtagcagccgggttagctttgtttatttgaaggccacagaaggcagtagctattttgacgataattttaataccaactttactcaggcagcagggagccgaatgagcataggcgtgtatcacgtttttagctttgaaacgacaccggaagctcaagcagctcaatttatccgcaaagtaggctccaacattggcgatctgccaattggtatttacctaagttattatcgcgagcaaaagccgagttccgcgtggttgacacagcatctaaccgagtttatcacgctcgttcaacaacgctatcatcgccaagtgttgctgatgggtagtcctgatattttaaaggtggtcaaaacagtggttccacaagcaccgcggtggacgatcacggacaagcggcctgctgacaatggcggcttttggcaatatactgacggtgcgcggttgccagacggtcctcaggcatcctatcgagcagcggtattcatgggcaagcgcagcacatttttgaagctggctcaatagtcggaccaccattaattcgtgcaaaaagccgagcattgcactgatctaacaaaaatgttcgttgaatgttcgccgaaactatctacttaattgaacgattgggacatactgataagcgaggtgaacagataatgaaaaaagtcctgatcggcttggttgtgctgattgtgctcgtttttggcggtttgaaaatttttgaaattaccaactatggcggaaccacgtactacacaaaaattaccaacactggtcagcgggtgacggatcgcgatgatgaaggcaacaagtacatcatttatgcctatgatttgcctggatatgatgagaaaggcggtctgcagcagttgaagtttaatgcgaaccaagatcgaccgctgagaaaaaatgcttatctaaaagtaacgtacaatgataaaaaaggggtcaccagctgggaaagtgtgccgcgttcggaagttcccaaagcggccttgtcaaaacttgaataaagcaatcaaacgcatcactttctataacgcgctccccggcgcaggagtctgcgtgtaaggaccttggtcgcaatgaccaaagaccggccatcacgtctgaggccacttacactccgattcctaaccgcgccggggagcgctcaccataacgcgttcgctggcgaagggatctgcgtgtaaggaccttggtcgcaatggccaagcccaggccatcacgcccaaggccgcttacactccgatccctaaccgcgccagctcacgctcacatcaaaaaaagtgcgatccgattttgctggatcgcactttttgcatcttatgcgctgggaatgataatggcgtaggtagcatcttctgcttcgtcataaatggtttgcggaccattatcatccgctttaatgactaatttgtacccataatgatcgagaaaagtcagctcgttgatggtgatgccgacaacttgcccaggtagcgttttattgtcgatcttaatctgcagttggggcgaaatcgctagcgagtgggtcttattggtttgctcatcaagaaaagcaaaactccctgtgaaattctttgccaacgccaatgcgggattaggcgccttgtcctgtgccttctgatgatgaccgtggtgcgcgagtaaatgtttcagcccgcgtaaaaaactcgccatgtttttcgacctcccatttctgtttaagcatagtctaccatgagtttttagtttagtggttacagtggtgctgtttttctgttactgggctgttacaataatcatgagcagttttgccagcttgatgttaaatcacggcagagctggatatcatacgtacagccgtgagtgactgttataatgcttgataacgcgtttactggcgcaggaacttgcgtgtaaggagctaagttgcaagggtcaagttgggccatcacgcctgaggacaccccttacaccccgatattctggcgcgccagcttacgtttagaggaggattttaccatgttgaaacttggtgtgattggaacaggatggattactaagcagtttgtggatgcagcggcggccacgaaggcatatacgcttactgccgtttattcacgtcatcaggagagtgctcagacgttcattgatcaaactgcaccagcaacagcgtataccaagatggacgattttctcggcagtgatgtcgatgtggtgtatattgccagtcctaacagtttgcatgcgtctcaagccttggcagctcttgatgccggcaagcatgtgattgttgaaaagcccttggttgcaaccgctatggaatttgaaaaactagacgaggcattacgcaaaaagccttctttgtatctctttgaagcagctcggcatgtttatgagcacaattttcaggttgtcgatcaatttacccatcatcatccgattgacggggctaccctgacttatatgaagtattcttctaagtacgatgcttttttggctggcaagttgccgaatgtttttaatcccgagtttgccggtggtgcattgatggatctgggtatttatttggtctacgatgccgtggcttggtttggggttcccgataacgctgtttaccttccacattttctcaagagtggtgtggatggcgatggggttgcgcgcttggattatgatcaattcgcagtaacgttgattacgggtaaaacaaccaatagtttcttgccatccgagatttattccggtaagcaaacgttgaccatggacaatgctgctgaacttgaaactatcaagctcgatgatcaagtgcttagtaccgagaaattggcgaacccgatggaagcagaagcagcttattttgccaaagctatcaccggtcatgatcgcaatgcgtttgataaggcatggcagctggccaaggaagttcatcaagtcatgtcaattctgcggacgtccgcaaaccttgatttttagtgagcgtgaaccggcgcggtttctaggctggcgaacgcgttatggaggacaaatattgtgacaattgcaaccccgtttcaaaaacgttggcaggctgccgggtatacggagcagacacccattcaagcagcggtttatcagccgttgaaaaccgatgaggatgtcatcggtctggctccaaccggctcagggaaaaccttggcatttggcctaccgttactggaaaaaatcgtgcccggcgatggtttgcaaatactgattttggcgccatcgcaggagttagcgattcaaacgcgggatgttctaacgccgtatgcacacgatatcaatgtggcggtgcagggcatcatcgggtcggctaatgtgaaacggcaattgacgaagctaaaagaaaaacctgaagtcattgtcgcaacagcgggccgtttgcttgaactgattcaatcgcacaagctgaagttggatggcttgcaaacgctggttgttgatgaagccgatgagatgttacgggatccgggattcgatcaggttcgcgaaattgcggctgcggctccggccgatgcccaacttgctttcttttcagcgacaccgagtccgtattttagcgagatgcataaatggtttggcaagacgcctaagctggttgatgttcgtgcgattgatcaaacacgcgggacggttcggcatttattcttgcaaacggatcgggcacatcaaattgattggttgcgaacgttggcgcacactgatggcttcaaggcactggtgttttttaatcaaaatgcatcgttggaacgcgcggccggtattttgcgccaccaagccgttcgttttgccgtattgtcgcgggaaggccgacagactagccgccaaaaagcgttgacggattttcgtaacggccggattaccttattacttgtgaccgacatggctggccgtggattggatattcctaagcttcctgccgtggttaatttcgaaccgcctaagcgtgctgaagcctacattcatcgcgcaggtcgtaccggccggatgggtgaacccggactagtggtaacgttaggagacgaccacgatcgccgggacttgaaaaaactggtaccgcaatatgccattcagcgtgcctatatgagcgatggaaagctggtgaccacactgccagcccgaaagccagataacgaaacgccggtgacggtcaaattaccagcaccgagtcagcgtaaaagtcggcaggttgcggctaaagatcggccggttgcgacaaatgaacccgaacaaaaaccgcggcgtaagcataaaaaaaagcggttacgtgatcagcgcaataaaggcaagcacaaaaacaacacatgaggctgcatcagcggtatgataaggatggagggcagtcatggcgagtatgaaggcggaacaaatggctgcaatgatgacactgatgagtgcagccggtgatgcggaacaggcaacaatggcagcgattgaagcagccaaagccgatcagatcgaccgcagccgcaaattgttaaagcacgcggatgccaagttgaaacaggcacatcaagcccagacccaaatgcttacgtatgaggcacgagggcaaaaagttgacgtaacgttattaatggtgcacagtcaggatcatctaatcagtgccatgacgattcgccggcttgcggatgatattattgatctttaccagcaagtgcacgcacagaagtaggtcaagggtttgttggtagaggttggttgtctggcgagtgcgttggggcacgggctcacgatcaccataacgcgttcaccggcgcagggatctgcgtgtaaggaccttggtcgcaatggccaaacccaggccatcacgcccaaggccacttatgctccggtttctaaccgggctggctcacgctcaccataacgcgttcaccggcgcagaagtctgcgtgtaaggacctcagccgcaatggccaaagtgtggccatcacgtctgaggccacttacactccgacttctaagcgcgccggtgaacgctcactttataaaagaggtaatccccatgaaaatcgagaaaacattacagacaccggcagcatttttatatagtaaaatcgttgcaccggttcaggccgatattgcggcggcgagtcatcgtaaggttgaagttgatgaacttgctggttatacctatcgcaaacaatttcctgatggtgaatgggcaaaggtcaagattacgcaaaatgtcatcaatcgtgaatttgcgatgctgacgatgacccgtttttctcgctttaaggttcgttatttgatcacgccgcttagtgctgatgcaagtcgtgtgcaggtaagtgaaaccgtgcagccggttaattgggcggcgcagcttaaacagatgatcaccgagctatttgtcggccataagcggcggcgtaatgttggccggatgttggactcgattgagcgttcttatatgacggcttaatgaggctaaaaggaacgatatcgttgagctgcagctgctgagacaacaaatctatttgaattgcgctgctgcttttggcataattgactttgtctggtgcccttagctcagcaggatagagcgactgcctcctaagcagtaggtcatcggttcgattccgatagggcacagtcataaaaagcacagtcatttggctgtgctttttattaaattgaaataggcatctttcaatagcaaacaaggaggggccttacatgcaggcgtttatggccgtctatgttccaggttggctgatttttattggcgggatcgtgttgatcagtacggtcaacggggcgacagttcaagccttggttaatcgcgttggtcggtctaatacgcagatctggtatatgaagccgggaatttttgtccatgaattacttcacgcaattgttgcgcggctatttggtttgcaggtgacgaatttttcgttgcgggctgatccgcgacaaggcagtgccgctcatgttagtttgcaatatcaacggcataatccgattgcccagctaggactgtttctttctagcagcgctccggtttggggaattagcctcattttgctggtactagggcggtgggcttttttctcggcaggtagtcaagtgtggcaggtgtttgcgaccacggccagtctcggtgaaaaatgggttatgatgcgcgacatgatgcagattaattggcgttggctgctgatttttttcgtgttaaccttagttttaacgccaggggttgctttgtcgcatcgggatttgcaaaatatgtggcagagtgcgccgattgcttttctggtaacaattgtgatcttttatagtttgctgacgttttggccagcaggatttgcttggtgggcgtgggtaaatttgaatttgttactgttgaatttagtgatgctgagttttagtctgctcatctggttactggtcagtatgttttagttgctgtgatgaagtagcagttggcgttatgctaatcagaaatttttaaaagggaaattcaattgcgatggcataatctatgattgagtcagtcaagtttttataggaggaaaaagatgcttttgccgcagccagcgacgattttaaaagaaaaatttgggtacgatcactttcgagccggtcaaaagcaggcaattgagcgaattatgaccggcaagagcacgctggtcgtgatgcctaccggtggcggcaagtctttgtgttatcaggtgccggcgatgattctgccaggcttgacgctggtcgtttcgcctttaatcgctttaatgaaagatcaagttgatgcgttaaacgacaatgccattccggcggcgtttattaatagcacgttggattatcgtgaaattactgcacgtctggaacaggcgcgcagtgggaacattaagttgttatatgtggcgccggaacggtttgatgcggattggttccttcaacagctcggtgacatgaatatctcgctttttgctattgatgaagcacactgtatttcacagtggggacatgattttcggccgagttacctcaacttggctaatgttgcggctcaattaccctcgcagccgccggtcattgccttaactgcgacggcgacaccgcgggttgctcaagatatttgccaacgcttgatgatcccggacgatggggtcatcaacacagggtttgaacgtgacaacctgagtttcaaagtggtgcgcgatcaggatgaggatcggtacttgttggattatcttaaactcaatgttgaccaatctggcattatttatgcaagtacgcgcaaagaagtcgatcggatttatgcgtttttgcagcataagcagttgccggtagccaaatatcacgccggcatgactgaaaagcaacgtgctgctaatcaggaagactttttgtttgatcgtaagccgattatggtcgctaccaacgcgtttgggatggggattgataaaagtaacgttcgcttcgtgattcatgctcagattccgaaagatttggaatcgtattatcaagaagcaggtcgcgccggtcgtgatgggttgcctagtgaggcgatcttgttatttagaccgcaagacttgcaggtgcaacggttttttattgaacagtctgaaggtgacgaggcgcatcaacggcggcagtatgacaaacttaaagttatggaacgctatgccaacaccgatcagtgtctgcagcagtttattttgaactattttggtcagactggcactgccccgtgtggacgttgttcgaactgcttagatgatcgtgaatccgttgatgtgaccattgacgcgcagaaggttttgtcgtgcgttgtccgattgcatgagcggtttggtaaaggcattgttgcccaggtcttggctggcgcccacaatcagcgcgttttgtcgtttcacctcgatcagttgtcaacatatgggctgatgaaaaatcggcgacagcgggatattacgaccttcattgatttcctgacggccggtggctttctggaaacgcgtggtggtcagtatccaacgcttggcttaaccgcaaaaggcgctgaagtgttacgcgggcagataaccgttttccaaaagaccgcgcaaaaagttactcagacgcttgaagtggatgacacggtcttccaagaactgcgtagtactcgccggcaattggcggagcagcagcatttaccgccgtatatgattttttccgataagacgttaaaagcgattggcaatgcgatgccgaaaacgttggatgagttgctggcggttaaaggggttggccaggcgaaacttgataagtatgggcagattttcttggacgtattgaaggcgattcaaacggagaaagcgtgattagggctcacgcttgcgataacgcgctccccggcgcagaagtctgcgtgtaaggaccttaagcgcaatggccaagagcgggccatcacgcttaaggccacttacactccgatccctaaccgcgccagctcacgctcaccataacgcgttcgccagcccagaaacctgcgtgtaaggacctcagccgcaatggccaaaacccggccatcacgtctgaggccgcttacactccggtttctaaccgggctggctcacgctcacacaaataataacgcatagaaaaaccgagccgttgatttttgcagaatgagtgcaaaaaagtcgcggctcggttttttactaaaataacggtagcgatgagaagttaggcccagtcgccgttgcggaaaattgggatgatggttccgtctggtttgatgccgtcaatgttcatcgcggcggagcccatcatgaagtcaacgtgggtcggactttggtttaatcccaccgccgcgcgttgttcgttggtcatggcaaccccgtctttgactgagaacggataggcttgaccgagtgccatatgatcggaagcattttcgtcaaacagcgtgttgaagaaaataagtcctgattgtgagatgggggaaggatccggaaccaacgacacttcgcctaatgaacgagcacccggcgttttcagcaggttttgtaagacgtcatcaccttgtttggcgtgggcttccacaatttgcccgtctttgaaagtaaagtgcatatcttcgaggatgttgccgccataactaagcggcttggtggaaacaacggtcccgtcgatgcgccgaaaatcaggggcagtgaagacttcctcggttggcatgttagccataaattcctcaccacgcgggttaaaagcgccggcgccttcccaaatgtggttctttggtaaaccgactaccaaatccgttcccggagccatgtaatgcagctgatcaaattgttcgttgtttaaccaagccgctttttcccgcagcttttgatcgtgggctttccaggcagcttccggatcgggttgatcgattcgggtagttttgaaaattgcctcccagagtagctcagttgcttcttcaggggtggcggcatcagggaaaactttttgagcccagcgcggacttgcagcaccgataatcgtccagctaatgctcatggaactgattgcttccatgagtcgtttgtaggcttttgcgaacgcttcttgatacttggcaatgcggttggaatcaattcctgccaagttatccggatctgatgaaaccacggtaatccgcttggcttggtgatcaacccaataatcgaattgacctttgacaaacgccgggatgttgaaaaggcgctcgtctgccatgtgcgccatatctaaacgcttgagtacatcatcgaaccactgaacctgaacttccgcggcaccgcgttggtaagcagccgcaacgatcaagcgtgccagctgtgcttggtccactgaaatttgcacgtaaacggtatcgccgggtttaacggacaccccaatatcgactgccaattcggcatattttttaaggctttcgttaaagttagataatgtcataaaaacgctcctcctcaaagtgattggcaatagtttaccatagggcggcgaattctcggtgcaaaatgctgctgtgccgtggcagaaatcttcaaaataaattaagaaaaactgaaatttattagtaaattctgtttccttctgacttcatgtctggtaaaataacaccaagacatgaagttggtcttttggagtggagatttaactttatttgtcagaattaagttgtgtgcaagctagttttaaataacttaaagaaagtaaggggaacaatatggcacgaaaaaaaacgatcacacatgatcagattttaaatgcagcatatgatctcgttgtggaacagggctttaaaagtttcacggcgcgtaatatcgctaagaagatgaactgttcaacgcagccgatttatttggaattcaagaatatggcggaattgaaacaggccgtgatggatcgtattaaagaactgctggctttaaagatggcaaaacactacaccaatgatccagtggttgatttaggtttggcgtatatctattttgctcttgaaaatcggccgctttaccgagcagtatttgttgaagatcactttggcgttgatgaaatgcgtgaatacgctatgagtactgctatgcgcgtgtttgatgcgtatgaaccggctaagaatctaagtgaggcacaattacgcaatacgatttgcggggtatggatcgtagcaaccgggattgccaatctcatggcaccagggttcatcgacattacacgcgatcaaatggttgatatcttaacggcggtcacacaagatttcatcgttaacggccgcttctcagatgacccgcgcatttcttggttcgaaaaagcaaaagtcgcccaaggctattaatagtttaattggggctaaccgttccgcggggggagcggttttttttgttggtgagcgtgagcaggagcgcttagcaatcggagtgtaagcggcctcgggcgtgatggcccgggcttggccatcgcgttcgaggtccttacacgcagattgctgcgactgcgaacgcgttatagaaagcaaaataaaaccccaaaattgcccaaaagagaatacttatgtccctgccgcaattttctcaataaccactgccccaacccctttactcacagctccctcacctcagcccctgatcgccaaatgcacataaaactggaaaactggcggccaatgcgctacttttgatttaataagtaagtgccatgctggtacaaatagctgacatgcaacataacgcgctcgtcaaatggaaggatttgcgttagaaggcgttcgaaagaggttattatgggaagttcatcagatctaaaagatttattacgcgaacgagtcgccactaagtacacaattgacgacctcaaggaaaccggcaaaaagattcggcaagcggttccgattgaaaatctaggggcggtcagcaagattgaccgtgatccagttcagtttattaatagtgttgagcagaatcttatcaaatcgttgctgccgatgcgccatcagcgaatgggtgcatcccaggcagcttttttccgcggcacggccgaattaatggcttatgatttgcggcaaggcgaaaaatcaggcattaatctattaattgacggggatgcccatctgcagaattttggtttttatgcctcgccggaacgcaatttgctgtttgacctcaatgactttgatgaagctcagatcaatagttttgaattcgacatcaagcgcctgctgaccagcgtttatttgcttggcgatcagcaagggtttgacagtgatgatcttgatgatttagtccaaaacgatgccagtatttatcggaaaacattacgggatctattcaagctgggcgcgcttgatcggttctatcaatcgactgaagtagaacgtttagtgcaggtcatccccggagccgaagattcaccgttgttggccaaattcattaaaaaggcgaccaaacgcaacaacgattcggtcattaaaaagtacaccgagacgaatgaagcggggcacatgcgatttaaagatgatccgccgagttcggttcacattgatcaaacaacttatcaggcaatttatgatggctttacccagtatcgcaaaaccacgcgtccggacattttggttttactgagccaatatcgcattactgatattattcatcacagtgtcgggattggcagtttcgggacgaattgttatttgatcctgttgagtggtttaggcggtagtcatttggtgctacaagttaaagaggcgttaccgccacgccgggaattattgcccaatatggaacgcatgaccttgcaacaagaagtcagtcaggggcagcgaattattgcggctcaaatgatcctccaaaaagcgtccgatccgtttctggggtggtttaatgtggacaacaagagctactatgtccgccaatttcgcgacatgaagggctccgttgatcttgatgagcttagttttcccgagttcaagtactatacgcaaattacggcttatcttttggccatggcgcatgcgcaaaccccgcaagcggcagtcgtgaccggttatctggataaacatttcgatagtgcggtgcaatcctggagcaagtggtatctgaatcaggtgaaggccgattattctgcgtttatgcgcgcagtcaagcaacgtgttttagcctaaaagtgcttgattagccggtgtatttatttgccggatttattcgcaaaatttattcataaaaataagtttagcttgttttctgcggattgcttctggcagaattaaagaggatgatcgtctgcgattaacgagcaaggctgggagggaggtaaagtatgggacggaagaagcacccgttgaaacggtcattattgtcggcagagcaagcagccgacattcgctcaggacgtacggctttagcagacatgaagctaccaaagcgcaccaagttttgggtcttcatcaagcttgccattaatcggatttccgactccaacattgggcaaagtgctgctgcattggcttactatacgttgctatcgctttttccgctaatcttatttgttgccaatgctttgccgtaccttggactgaagtatagcagtttggccacttacttaacgcaggcggtgccggcaaatgtcatggaatggctcgatcccatcatcgcaaatttactggattcaagcagcgggggattgctgggaatcggggcaattgcaacgctgtgggcagccagtctaggtgtaaccggcttaaaaatgggctttaatcaagtctacggtgtggaggcaacgcaaaacttcattattcagcgattattatcaatgctcatgacttttaccttaattattgtgatgggcgccattttaattgcctttgcatttggccgccaatttttggaatggctgataccgttgctacgactggataccagctggctgcgaacctttaatacgttacgctggcccatcacggttaccgcattgttcattattattatgtttttggattattttttaccgaatgtcaaaatcaaaatgtggacggtgttacccggaactgccttcaccgttattggctggctcttaattgctcaggcattttcgttatatatgcattattttggcacgcgttatctttcttatggcacgatcggtacgtttattgcgatcatgctgtggttgaatttctccgcgctcgtcttgctttggggcgctgtgattaacgcgttaaccgcagaatacttcatcggccggttgcacagcagcaagggtaaagtgcacgactttttgaaacgccgagtgaagtcagcacattcggaaaaagaaactccgtgaccgccaatataagatgatctaaggcatacgaaaaggctcgcactgaaatcagcgcgagccttttgcctacttactattgcatggcgttgaacttatcaaccaactgttttgtaaaagcttcaagatgcttgatgtcatcttcttcaggagaaagatcaatcttaacattctctgctcctttggtggcgccggttttggcaaaggccttgtcaaaatcatcaaccgaagtggcaaagtcatcatagaagcggtcaccgctaccgcaacaaccatagacttttccagttagatccagctcttgcaattcttcatagaaatcaaccgcttcgtccggcagttcgccatcgccgacatctgagtacgtgtaagttgccgtgacacaaatatcgacatcttcaaaatcactcgcgagtgcttgggaaacttcagtggtcgtcacgtccacattcaggtcttcaaaagcttcttcaatgataccggcaatatcttcattattaccggtcaaactggcatatacaatccgtgcgcttgccatttttcttgtattcctcctaaaacacagcactcgggagcttacaagtcggcgaggctgtcattcttgttcattcgcttgattatagcatacgggaaagccgcttggggagattcactgaagttggctatgtgtggtggggtaggctttggaccgtccccccttcgtctcctgatttacgtggaagtattttgttgacgtcaattctcattatctgtagactgtcattacggttttgaaaagggattcatcatctttttcgttgagcccagtgatttggatggcacacacctctcgacattttgataaaacggaggtgacagccatgccaaaatcaggagacgaaaggggatcgccgcgttggacgtggcaacgattatcgtcgctataagcatactgcttactagcggtgctaaggcatacacgataatcaaaaaagctaaccgaaacggctagctttacccaaaaacgtcatctgatatcacgttgaggtcatcggggctccatcctgatggcctcttttcgacctctaaagtataccttaggcgctggtgaagcgtcaagatattgactggcttgtattcattgaatcgcgttatgtttggagtcttgtaccgtacgctctccctgcttattatgttgatttattttattgacgcagattcatattatctatagactatcattacggctttgaaaaagactgaaaagcttttttcgctgagccgagtgatttggatggcacacacccctcgacattttgataaaacggaggtgggggccatgccagaatcaggagacgaaaggggatcgccgcgttggacgtggcaacgattatcgtcgctataagcatactgcttactagcggtgctaaggcatacgcgataatcaaaaaagctaaccgaaacggctagctttactcaaaacgtcatctgatatcacgttgaggtcatcaggaagcaccctgatggcctcttttcgacttctaaagtataccttaggcgctggtgaggcgtcaagatattgacgggtttgcattcattcaaaaaagctaaccgaaacggctagctttacccaaaacgtcatctgatgtcacgttgaggtcatcggggcttcatcctgatgacctccccctcgacagataaagtatatcttagaaactggtaaatagtcaagggtgttaactgatttgacgatgggattaactcgcatactaacagcattggttgtttagaaaatgcgtcggctcgagctctctttaaacgcgctcgccagcccagaaacttgcgtgtaaggaccttggtcgcaatggtcaaagcccgaccatcacgcccaaggccacttacactccagtttctaaccgggctggctcgcgctctcttctaattaatgctacactaattgcgagttaaattcgtattggaggctggaagtttgatcaccatcaaatcagcacgtgaaataaaaggtatggctaagtcgggagcgattctggcggcgatgcatgttggcttgcgcgatattattaagccgggtatctcgagttgggagattgaaaagtttgctaaggagttttttgaatcccatggcgccaaggctgagcaggtcggttttgaaggttataagtatgttacttgtgtcagtatcaatgatgaggttgcccatgctgtaccgcgcaagggcttgaagttaaaagacggtgatgtcgtcagtgtggacaccgttatcagttggaatggttattttagtgactcttgctggacatacggggtcgggaaggtttctgaagctgaccagaaattgatggatgtgaccaagaagtcgctttacctgggtattgacgaagcggttgttggtaatcgtattggtgatattggcgctgcgattcagacttataccgaagatgataacggctatggcgatgtgcgtgaactggttggacatggcattcagcctacgatgcatgaaagtcctaacgttccgcattatggcgtgcccggtcacgggttgcgcttgaaagccggcatgacgattaccattgagccaatgattacggaaggtacatggaagattaagggtaaacaagttcccggcgatacatgggaatactatgtaaccgccgatggaagtaagtgcgcacagtatgagcataccctggtgattaccgacaatggtcctaagattctgacctcgcaaggtgatccgattgatgctaaatatcagttaaccgaagacgatctgaagacgcttccggaataacggggatctccgttactatttttatgtgttatgaggtgccggaagcatcaaatcgtcaagcaggaagcaagcagtcattgtttcctgcttttattttattgtcttttttaaaatgttaaccggtttcgtttaacaatggagcaattacgttatactaaaacacgaaggaaaagagggacgatatggcaggtcatgaagcattggtttcggtcatcatgccggtttataatgccgaaaagtatttgactcaggcgctggatagtttgctcgcccaggactatcccaattttgaggtactttgtgtggatgacgggtcaatggacactagcaaggttatcttggcgacttatgcacgtcagaatccacggatacgtgttattcgcgtggaaaacggcggacaggcacgggctcgacaaattggcattcaacacgccaagggctcactgattacctttatggatagtgatgatctggttcatccccagtggctagcaaccatggcagaagggatgcgagccccacgcgtggatatgtctgtggtcaattactataactatatcggcggcaccaagctgaaagcccgttcttttcacgagaaggttaagattgccggtgatgacaagtaccgttattggcttgaggatcgcgacctgcgaggatatttgtggaacaaaatgtttcgcgctgagttatttagccagccggtaccagtggcgaacttcaacctgcttgaggacgcctactttatcggacaactgctgccacgaatagaccagatcaactttattgatgaaccgctttactactatcgcttcaatgcgaccagtagcgtccacgccaagtttcaaaagcgtgatttggaagccattcatcaactgggtgccgttttcttaacgttggctcgggaaaaaccggagttaacttcactggcagttcgtcgttatgctgccttaagcttgttcgttttatcgaaaatgtcgccacggcaactcgtagctaactgggggtatgttcaacagctagggatggtcttggcacaatatgcccgcgagtttcaggggattatctcagcgggggatgcggatgatttggccacagataagtccgataaggcgagtttgttggataaactgcgtgcttggtcgcatctgttaggactgccaacatttgatgacttgaacaagttggcagatagtgaagacgagaatgttaaaaaggagtcttagcgtgtaggggggattcaagggtaggttgggttgtactttcataacgcgctccccgccgcagaagtctgcgtgtaaggacctcagccgcaatggtcaaagtgcggccatcacgtctgaggccacttacactccgatttctaagcgcgccggctcacgctcaccataacgcgctccccgccgcaggaatctgcgtgtaaggaccttggtcgcaatggccaaagcccggccatcacgcccaaggccacttacactccggccctatccgcgccggcttgcgctccgcaaaaaagccatttgccaaaaagttggcaaatggcttcgtatcgagatcaaacatatcgcggcacgttggggtgttggtgcaggcaattaagccggttttttctccgtggtgaagatttcggtgctttgggtttcggtcacctttgcgccaaccggagttgcatacaggccgatgccttctttcttgaacgcttgagcttgtgcaactgcatcggcaaaggcttgtgcttgttcagccgtgatggcaccttcgtacttgctaatccgaatacttgtggatttaccagcttcggatttgaaattaaaaatcagtgttttcattgattatccctccgtttaggctgtgacttctgcgttttgctgcaagacaatgctcgtcaaagcagcgtttggataaagcttggcaaaggcttgcccgatcgcgaccagttgctcgtccttcgcatcggcagcgacattgttcatccggcgcacctgcttaaatgcctcgttctccggatcagttagggtgtacacgatggtttgcttgttaacgttgcgactcatgatgtttcctcctcagttagaatttgtgttgtccgaatgtggcctgcattccagacagttattactggatattttggtccaaaatcccgatcagtgtaggaaatttttgcgtcctacactgatataaatcggtgagttagtgaatatgacaacccttaacttataaatttgtagccattgcagaatatcgaatgtctgctaaaataattaaggtatttctttagaaagagtaaggtttttgctgacttacaattttgttatgtgcagtcagctatacttacagtcggattccttctggggtccttgattaatgaaaatttgaagggttctgattgtgtgataacagcgcaggcgccaggtaaactttatgttgccggtgaatacgcggtggtcgaaactggtttccctgcgatcatcgtggcgttagatcaattcgtcactgtaaccgttgaagcaacgaaacatttcggcagtatcgtgtctgaacagtatcaggaaaattcgttgtattggcaacgtcaaggcgatgaaatggtctttgataaccgggataatccgttccactacattctctcggcaattaaattaacggaacaatatgcgcgtgaacttaacaaaccgttggcgctgtataagttgtatattgattcacaactggatgctaaagacgggaaaaagtatgggttgggtagctcagccgcagtcaccgtggcaacgatcaaagcacttgccaagttctatgacttgaagatgtccaaggatcaaatctataaactggcggccattgcccatcttgatgttcagggtaatggctctttaggtgacattgctgcgtcagtttatggcggttggattgcttatcgttcgtttgacaaagcatggttggcggcagctagaaaccaaatgtcgctatcggcactgatcaatgctgaatggccggagttgtcgattgaactcttaacggcaccggctgatatgcaacttttgattggctggacaggatcgccggcttcaacctctcaattagtcgataaaattacgttagccaaagccaaaaaaccacagctctaccatgatttcttaactgctagtcgtgaaacgctggagaaattgatcgatgggttccgggagcattcgcttagccacattcaagctggcattcggcgcaatcgcgaattgttggatgaattagcgcacttctcgggagtggcgattcagacgccagcattacgacaattggtgacgttagcagagcaagcagacggggctgccaagtcttctggagcaggcggcggcgactgtgggattgttttaattgattctcatcaggcgattcaacccctgctagcagcttggcgtaagcaccacattgaaccactgaaattcaaagtacacgaaatcaacgattaacaacatctcagctatgatttggtaagcagattccggatggataggatccaatggcgaagcaaatacccagtagctgggatttttttatttttatacgaataacttatgaatttttctgggaattatcagaaaaggcgtactcttcgcaagcggtttctagtatagtagagtaggtagttaaattagtagagaagggacttgtatgagtgtgaaagttcgcaaagcagtgataccggcagccgggcttgggacccgttttctgccagcaaccaaagctttagctaaggaaatgttgccgattgtcgacaaaccgaccattcaatttatcgttgaagaagctaaggccagtgggattgaggatattctgattgttgagggtaaacaaaaacgctctattgaagatcattttgactcagcacctgagctggaacagaatctgaaagaaaaacataaagacgccttgctacagctggttcattccacaaccgacatcggcgtcaacttattcttcgtgcggcagccatatccgcgtggtcttggtgatgccgttcgcttagccaaatcgtttgttggcgatgagccattcgtggtcatgttgggtgatgacctgatgaatgacaaagtgccgttgaccaagcaattaatcgatgaatacgataagacccatgcgtccattcttgccgttaaaaaggtgccgcatgatgaagtatcggcatatggcgttattgatccggaaaaagaagtttccaaagacctctataacgttaagaaatttgttgaaaagccagccgttgctgatgccccaagtgacttggcaatcatcggccgctacctgctgaccccggaaatttttgatattcttgataatcaaaaaccaggcaaaggcaatgaaattcagttaaccgatgcgatcgatactttgaaccaaactcagcgcgtctttgcacatgagtttaaaggtgatcgctatgatgttggtaataagttcggatacgtcaagaccaatgttgaatatggtttgacccatccggaagtaaaagatgaactccgcgcgtacatccttgatctggctgctaagttgcagtcaggcaatcctgtggggaagccggcaaataagaaataggcattgtatttttagccataataagagctcgagcagaatcggttatgaggatgctcgggttctttttgtgcgttgagcgctatgccgggtagtacaggatgatattaaagaaatcctttttttaaaatggcaaagcattatcaaccgagcaagtgctttcattttttgcattacttacatataattaactatgtaatataaaaagtattataataatttctgaataaggatcaaagaggcagtcaggactattcgccggtggctggtgaacaaatcacgaataataccgacactttaaactggcaaaatatccaggcggcggcagggacattgtattatcagttagaagttgaatttgatagcggccaaaagtcttattggtacagtaacatcgccccactaaccatcaccgcctccgctccgcagctgcacgcggttcctaatctgcagtttgcgcttagttcgggcgctaacccaagcattgccgatttttatgccgcacagggtgtgaccatggtgtatcagccgagcacaatcgctaaccagacaaactgggatggtaacaatcatggtgcgttggcgattgctggcggcggtagtacctggagtttgaatgttcagttttcaccgtttaaaaatcagacaacgcagcactatttatcaacggagactggtggcagtgcggccgtgaccttgcattttgctgatgggaccgcggctcaggccaaagatgaccgccagccggtgacggtttatagtaaagtgaccaaggatgttactacgacaaccgctaccacgacttcgctgcaggtgccacaaacgtcaacgattcaaccgggaacgtatcagtctaccgccacttggacgctggtcaaggcaccttaatcgtgtgaatctaaaaaacaacccgcacttcgctatcattgcgagaatgtggggttatttttgcgcagcggcaggcttatgcgtcagattctgatagcccgttttgccggatgacttgctgataccaataaaatgattgcttccggtagcggtttaacgtaccgctgccatcatcatgtttgtcaacgtagatatagccgtagcgtttggccatttcgccagtgctggcggagattaaatcaatcggcgcccatgaggtgtagccgattagatccacgccgtcttgaatggcgtcatacatggcagcaatgtgtgcgcgaagatagttgatgcgtgccgtgtcattaacggttttttggccatcttgttcaatcaattcgtcacgcgcaccgaagccattttcgacgaccatcaccggcacttggtagcgatcgtaaatttgattaagcgccgtgcgtaacccgcgaggatcgatttcccagccccagtcactgcgttgaaggtagggatttttgacgccagcaaaaaaattaccgccgctggtttcgccgctttcagtggtggtcatagtgctggattggtaataagacaaagcaaagaagtccacggtgcctcttttaaggagctcttcttcccacggctctatgtcgatggtgatatcgtgatcgcgccaataacgtttggcaaaatagggatagcgacctttcacttggacatcgccgcagtaaaagttattgagttcggtggcagtttggacaagggcaatatcttctgggtgacttgtcagcggatagagcatgcgataagccagcatacaaccaattttcaggtgtggatcgaacccatgggcaaagctgcagactctggcactggccacaaattgatgatgcagtgcttggaggcgcatttgggtggaatcgatatcagggctgatgaatcggttggtgtcgtctacatacataccgccagctaagtaggctcccatcggtcgggttagcatattgatctcattgaaggtcagccagtagtggacatcattgtgaaagttggcaatgacagtttgcgcaaatgtaacatattcttcgatcatgtctcgtgacgcccagccgttgaacgccttcgtcagtacaattggtgattcaaaatgcgagatcgtgacaagtggctcaatgttgtaacgcttgagttcagcaatcaacgccgcgtaaaaggcaagcccttctttgtttgggccgtcgcttgcagaaccgtttgggtaaatccgcgtccaggcgatggagaagcggtagactttaaagcccatttccgcaaacagtgcaatgtcttcttgataacggtgaaaatgatcaatggcttcatgactggggtaaaacgcgtccggacgtacctcgcgcgtgagttgacgggggacattgtgagtgccacccagtaacaagtcgctggtcgacaaccctttgccgtccacgttatacgcgccttcaagttgattggcagcagttgcgccaccccagagaaaattttcgggaaattgacgaatggacataacgacctccttcattaggtttcggggatgaaactgaatagcttatcgcctgggcggacagatgctttttcatgcacttcaatccgttcgggaggcgtattcggtagcaaaacgatcaccgtgggatcaaagccagacttttcaatcagcggcaagtcgattttaatgagcggttggccgactttgacggattcaccttgagagacaagaggtttgaaaaagcgtccatccagtcgcaccgtgtcaatgccgatgtggatcagcacctcttgtcccgaggccgtggttaagccgattgcgtggttcgttggatataacatggagacagtggcatcggccggtgcaacaatggtgccgctttcaggaataatagcgaccccgtgtcccagcgtgccagctgcaaaaacctcatcctggacgcgagcaagcggaatcatctcaccggcgaccacactctgaaaaggttgcggctgggttttagcgctggtgcttgcattggtctcgacggtggcaaagaagtaggtggaaagaaaagtcgcgccaaacgcgatggccacagtcagtaaggcgttgcggaaattagtaggattagcgccgatgaagacgggtagggtgaagatccccggtgaaccgaatgaatagcggaccagcccagtgagcccggcaaaaagaccggccagtcccccggaaaccacgacgcaggttaacgcgtgtttatacttgagcgtgacgccatacagtgccggttccgtgatgccggataacgcagtgacgctggcagagagcgcgatttggcgtccgcgggtttgtttttcgcgcacggcaatggcagcagcggctccggcttgggcaatattgatggctaacatgccgggacccataatcgtttcactaccaaacttggtcatggacaaggtcgctaatggcaagagtgaaacatgcatgccaaccatgacgagcagtggagtgaaggcgccgaccagagttggaacgagccacggcgtatgttgattaatgaaggtgacagcggtataaaggccatcgcctaaaagactgccgatgggaccgatgacaattaaggcaatcggagcggtaatgagtgcgactaacagcggtttgagcatgtttttgatcatgttgggtgcgactttttccgcgaatcgttcgacatagctcataaaccagacgattaaaatgatgggaatgacgcttccaccataggatgctagacgaatgggcgcaccgaataacgcaatgggcttgcccgctgcgaccagcgctgtgaagttagggtgaagtagcacaccggccatcatcattgccagataggtattagtgttgaacttcttggctgcgctgacggcgagcatgaatggcagaaaataaaacgcggcatcagccatgaaactcaaggtgagataggcagtgctttttggatcgaggcccagtaaagctaagatggcgatgacgactttgaacatcccgccggcaatgagaacggtgatgatcggggccatgatactgacgatggcgttaagaatccgtttaattaaattcttttcttgggcttgtgtcgtttgattcggttcgcctgcttcatgaagctgatattgttgttggatagcggcatagtatttggtcacgttagcaccgatgacgacttgagacttatcgccggccaccacggtactaagaacttccggcattttttcgagttgtgcctgattgaattgctgcttatcgcgtaaagtgaagcggaggcgagtggcgcagtgggtgaggcttttgacattttggatcccacctacagcagccatgatttgggtggcgattttggctggatcagacatgttcaagacacccccttaacgccacggtcattttgccgcgttgatgcccgaatcctttattcaactggttgctcgtgcgacagtcatgcttttgtacttgcaatatgaataacccccttcataaataaaccctgttattggcagtaaaaaaacagacatagccaagaagatcgtttgaacgataaaacgatgatcaaagttctgtctgtttacccggtaacagtagatgtgatatcagctgttaagcgtatgataacggatacaaaaataaaaagcaacccgataagattgctttttgcattgtttgtatccaactatttattatttatctaaaaataaatgataaatagcaagttaaattaaattgtacataaaattaaaatgaataccaacatgttcatgcttaataatctcagcggcgaatgtttaatcaaactgttacggctaatgatttttaggctggccgccagtcaccatacgcttgtgaaaacgcgggtgatattcatagaaaatgagggctgcgaggccggtcagccccatgatggtgaccagccacccaagcggtatccccggggtgtggtaagtgagggtaaaggtagtggcttttttagggactttaatcccaatgaagccgcgataattttgaattttcacggactgggtatctgcttgccagcctttttcgtaagggatagtgagcatgatgtagccactgttgttttcttgcgtggttaacgatagacggccgttttggatggtttgcttaggtgcgttggctttggcggttttaaccgtttgcttgaaggcttggcggttaagggtatacagcgcaaagtgatcgaggtcgatttggctgaaaccgcgattgaaggtcaaggtgacggtggtcggtttcgtggcattaagtggcaacgatacggtcttggagccgttgtcgggatcatttttaagggggatgttgttaatgctgatggtcatatccttgcgcatgccttcacccatcacgagatattgctgctcgctgctagggttgacactcaaggtaatgctggccccaagctttttgtttaccttggttgccacggcattggtgagggtggtcagcggtttgacgttatcgacactgatcccggagaaatcagaagtggtgaagatcggggccgtttgctggttcgtcaaagtggcaaaataagcattttgttgcaggaccgggtttgcctgcacttgggttggaattttgctgaaaatctgggtggccacgggtaaggcatccggatttttgtagatgttaaagagctggttgtgaccgactaatttgtaagccggcaaatcatagcgggcattgcaaatattgcgcgaggaagcttgttgatactcggaagtgccgacttttttactcgttgtgttgaggagtaataactgtttgacgccgagtaagctttctagcggccaggtgaggtcattgtttttgacccgcccggctgaaccgattgccccgacattggtgagggtattgatggtgctggtgtttaaaaccgatgaaaaggtgctgatcccgttgaaattatattggtagggatcgtccatggagcgttgggtgtcggcgttaatgcgatagaacccggatggcccgatctttttggcgtcgttgtaagcggcactgagcactttgctggtgacggtgaagtcggctttggagatgaaactgatggcgccaaggctggcataggcattggcgcctaagtcgatgacaagcaaagccaaaagtgcgccaaccgtccattttaccgggaataggcgggtggcataactgtagagcagcacggtggcggttaggagaaggatgccagcgaggatcagatgcggtaaggtgacatatttgtgtgttcccatgcgcaaggcggcggggatgatgagtagcccgccgacgactagactggtgaggagtaaacgtaaccgggacacggatcgcagctgcatgagtccacggagactgagtagtaagaaccagaagatgacaatgaatgagtggcggtataaataccacaccggcgcgcgaaacccttgccagataatggcgagaggattgagccagatggataatatcaagagtaatgtcatgccggccgaaatcaagcgttcacgaaccgggatcgtccgagcaaggaaataaaaactggcacctaataggccgatcatgcccatatacaggttaggcaggccattggagagctgatcaaaattgaaactgcccggaagtagctttgatggcaagtcgatcagcgaatacaaggctttgaaactgaaatcagcaccggcgctggaaaggcgggaagcactcagcgcgtaataggttggaatgagcacgaccgccgcgatcataccgctgagtaacgagccaataacgaataggctgatttttcgcagtaattgcagttgatgttgaatcgcccagcgccagccaaagtaaagcgccgcaaaaatggcgaccatgaagccaatgtaataattggtgatgaatgccagactcagcggaatgacataaggtaacagccgttgctcatcaaataatcgttcaatgcccaagaccacgagtggtaacaggattaccccgtccatccacatgatattcaaaaagttggcaaccagaaatccggatagaccatagctaatactgaagacaaagctataccagcggccgcccgtcagataattcgccaacgcttgtgctgccatggccgcggtgctgtatttaagcgcggtcacgaataaaaccgccaccggtaatgcggagcggggaaccagaacaaatacgaggttaaacggacttagcaaatagtaagtccagttggcatacataccgccgccaagactattggaaaaagaataagctttaccggcagtacccagcagtgcgtgttttaggtaagtaaagaagtcgacatattgaacggccgagtcattagcaagaatggatgatgagccaaacggagccatttttaaagccgcaaaaacgatgaggctgatgacaaaagtgacgccgaaactaatgaacagtagtggccaggttgattgtttgtttgaacgcgacatatcagacgaggactcctttttgaaaaccttgaaaatcaaatattgttattaattatgatagcaagcgaaatagcaggttaaaaaatcaggtaaccttaactattaattaaatcataacgcagaatggctcggcacgcgatcgtcaggaactgagcgcgagccggcgcgcttagaagtcggagtgtaagtggcctcaggcgtgatgaccgtactttggtcattgcgcctgaggtccttacacgcagacttctgcgccggggagcgcgttatggcaagggctccgttcctcggcacacatgacaacttacgatttgaaagttacaatattgggaaagcactaacgggaggattttcatgcgcgcggataccgaagattcgggtttagtttcacagcttaaggccaatgcaatctggctattgccacttttagcgattattttggtgttgcttgtccagtggccgcagttacatctgacctacattttccatcaggatgatacgatgccgcagttacgccgaatggagagttatgtgaccagcgtccggcatggtagctactttccaaaagtctttcccgaagaagtacgcaatttcggctatgcttttgatgccttttacccgtcattgttgttattaccatatgtctggttgcgactggcagggatggggattgtcagtgcttattacggctatcagacgctgattctagtggcaactgtggtcacggcttacgttagttttttgcggattcgccggcagccactggcaggattcgtctttagtctggtttacacaacagcggtttatcgggccttggatgcctttgtacgcggggctttgggcgagaatttggcgtttattttcttgccggtgattgctgcaggtatgtatgaaatttatgccaagcagtcgcgtaactggttcttgctggcatttggcgtgactgggttgatgtacgcgcatatgttgtcactcgtgatggtgttggtatttcttgtcggcggattcctggttttggtggcgttgcagcgggtaacgtggcgcatggtcagatatacggccatggcagcggtgagtgcgttgttgatgggcttaggcagttatttgccaatggtcgaactttcccggcacctgtcacttaaactcgcggattcagcaacgatttggcccaattatcttcaatttaacttaggtgatttagtcacgaattcattgagcatgtatgcctcaaccagcagcatgcaaaatgtcaatcaggcttttcggccggggattggcgtcttgatgcttgtgacgggcattgcactcgccattttttgggggaagttgtcgcgggcagtcaaagttgcggctggtttgggctttattggtatttttctaagcacggatttatttccgtgggcattatttagcaaaaccgtgttaggcacgattcaatttccttggcgatatttggagttagtgaccttattcttcagtctggcgcttggtcttttggttgcagatcggccgcaaccgcaaccattagcattggggttggtgctggcgacttgcatcgtcggcttcagctatgccgttaatatcaacacgaccatgatcaatgccaacacttaccgcattacagataaaaatgcggtttcgtactatcaggattctaccggtggcggaagtgaatatgcgccgcgagaatttgacatgaccacattctttaagaagaatcatcagacggttttggcttcacataaccttgagcgtgttaccaccccgacccaagactacaatgacatgcaattttcgtacacgagtcggcgtaccgtgacgctaagattgcctaagtttgcttatgttggttacacggtgacggttgacggccgcccaactgcctatcacccaagtggcaaacttgcccgtatcacgcttcatgctcccgcgggcacgcatcatgtgcgggtggtttacacaggaaccatcctgcaacatgtgaccgggtggctatcgctggccgctgcgtttgtctttttggcttggtggataatcatgcaagctcgttggcatcgggatgtggacgagatgctggattagtgagcttgcggaaagtgttgtcggtggcatcgcgatataaccagaaaaataaggcaagctgaccttgattttgcaaagtcggcttgccttattcacttaatctcgcgtgcaatgaaaatggggcgccttttggtttccaaatagatgcgaccgatataacgtcctacgatgccaagtgcaaagagctgcaggccgccgatcatcagaaagatcgagaccatggaaggccagccggatgttggatcgccgaacaaagcggcacggacaacgatgaagatgagggcgatgaacgcgccaatgaagctggtgatgccgacaatagaaacaaacgttaatggggcatcggagaagtcgatgatgccgtcaatagcataacggagcaaattggagaacgaccaactcgtttggccgtgttggcgttcaatattgcgataaggtagatacttagtcttgaacccaacccagctgaaaagtcccttggagaaccgattacgctcggtcatttggacaatggcttcaaccacttgccgcgtcattaagcgaaaatcgcgcgcgccgggaacgatttgcgtttgcgacactttgttgatgaatttgtagaacatatccgaaaagaaggaacgcagatgagcctcgccagaccgatccacgcgctgagctccagccatgtcgtagccttcttgtaaaattgcgtacatatccggcagcattgatggcggatcctgtaagtcggcgtccatgacggcatagtagtcggctttcgcggttgaaaggccggcatacatcgctgcttctttaccgaatgagcgggaaagatcgatataatgaacctgatcgtctttggcttgcaactgcttgatttgatcgagggtatcgtcagtggaaccgtcgttgacataccagatttgcggttgcaattgcggcaagttttcacgaaaagtcttgatcaatgcctgataaatcagtggaacattttcggtttcattatgacagggaataataattgccacgctttgcggcatgaaacggcctcctcaatttcaagttaattctcttaataagttgatgattcctagcaaaatcaatactcaatcatcatgcatcgttttaacggccttggccaagctatcggcctgacttgatacggttgtcaggttggcggtcatgacatcaatttgctgattgagtgagctgtaatattggtttagttgggaaatttgtgtctctaggtcggcttgagacgtctcttcactgtcagcagtgttatcaaaaaaggcatcttctgctgtctgcatttcgcggtagtagctaaccagcgttttgtgatccaatttggcgagcttcagacttgttagcactttgttgacttgagtttgaggggtatcatcggtcggctggttatttaacttagtgagcgtgttattggcgtttaccaaagcagtgttggccgcctcaagctgtttgaacgcagctgcacgtttggcgagcagttttttaacgggcccgtcatcatttctgaaatctgtatcgggatgatcttgatacgctttttcaaacgttgatggaaacgcgccgacgctatcgccaataatttttagtgcagcttgttctttttgcacttgtgtttgaacggtagcggttgtggtttttaattgttgtttagggtttaaagtggccgaacatccggcaatcagaagtgccagacccgcgagccatatgagtatttttttcatcagcaactcctctaaatatatggtagcgtaaagccggctgaaatactagcagcagggggattgcaaataaatttcacccctgaatcctgtttcttcaggatacgagaaaaatgaagcggcaacaagttattttcaaggatcatactaaggtggtcggtcagtggaaagtttacgtgacgacagccgcggctaacggtaaaataacagatatctgagcgcacatagctgacgggcgggctaaaaaatttgtggtgtaactggtttgatgcgttcctatgctaaactgacaggtggagggtgatgacgatgcacattgggatgcgcacaatcaaaacagcggtagggacagcagcggcgatgttgatcgcttattcgttgcacttggaatattgggccgctgccggcattattactattttgtcagtgcaaaacacaacgaaggcgtcgtttcggttagtcgcctaccgcttattagccacgctgctaggattcgtgattgcgatcggggcgttcttggttttaggctacaatgcgtttgcttttggcgttttcttggtgatttttattccgattaccaatgtgttcgcggtccaaagcgggattgtcatgactgccgttttggtaacgcattttatgatggcgcgcagttgcagttggttttggattaaaaacgaacttttgctgctttcgatcggggccggggtggcgctcattgccaatctgtttatgccaagtcttgaagctaagatcatgggctttcaaaaacaagtcgaagccgagatgcgtgaaattattgatcatatgagtcagcagttaggggcagatcagcttaaaagtgcggacaattgggctaatttatctgatttgaagatgacgctggacgcagcagttgcgtgggcaaatcgacatagcgacaatcagttgttgtctgaaaacgactactatcaggcttattttgaaatgcgcgcgaatcaatatgaactgctgcggcagatgcaagatagtttggatcgtattgaaacgccggtgatgcaggcggcggtgatcagtgatgccttggcgatgacagccagtgttttgaatgaagacaatccggcagcgcaattggtgacaatggtgaagaaaattcagcgtgattttgctgcctcacccctgccaacggatcgcgcttcttttgagagtcgcgcccggttgttttattttctggaggatttttcccggctgttgcagttgaagcggaattttaatcatattatttcttcgcagaattgaatgacaggtggcggatttttaggacttgagatttgggtaggttgcggttaccatagcgcgttcaccggcgcagaagtctgcgtgtaaggacctcgaacgcaatggccaagcccgggccatcacgtccgaggccacttacactccgacttctaaccgcgccggttcatgctcacctttctacttgcttggtttttaccgtgatgttagactaaacatgtactttttgaatggtcgtggttgcatggtttcaggactttcttccacttgtaccaaacagaaatacacgatattatcatgcgtcaataggcgcaaggaggaatgttctcatggaacacggcacagttaaatggtttaatgctgaaaaaggttacggttttatcacacgtgaagatggcagcgatgttttcgttcacttctccgcaatccaaggcgaaggttacaagacccttgaagaaggccaagcggtaacgtttgaagttgaagacagcgatcgcggcccacaagcggttaacgttaacaaagactaatttaaaagtttcaaaacaaaagtgtactattttgaattttatttcaaaatggtacactttttcttttgattaggtgattagcgtttagcgcttcaaggctcagaagtcccgtctggcaaactcgggatcagataacacgtaagttcaatcaccgtaaagcacaagtattgccgtggtttgtaatgacacatatacgtggtttgtaatgacacatataattacaggcgaaagggtgacaagcatgactgttaaaacttatcggctaggaaactcaattgtggttaccattccagcgttcattcaatattggcgaaaacgttgaatatcaaccgattattgacgaaaatggcgtcatcagcctgctacctgttaagcatcatatcttcaggggtgatgctggctacgatttacgtcaggcaatgctggaagaaaatattggcgacaatgatattccaattggacgtgaggacgcctggcatgaatagtgatagtcagatcccatatcagtaggcaggttgggtatttggatacattaaaagatcgttcatttatgtctgtctatcaaacattcaaaaaggggtctacactttttggcattggtgatatatcaacactaaagatataggccttttttggcgatggagagcttcataagcagctgttcatggtaaactgataggtagcagttataagcttaggattgggctatggaaggcggggggcacatgttaagatttgaagaagtagcacctgacgcaagactccaatatctggatctcttgttggtgggcgatgaagatccggcgatgcttcagcgctatttaggtgcagggacactttttgcggccactgatcagcaggtgccggttggcgttgccatggtggtggcggtcaatgcgaccacggtagagttgaagaatctcgcggtcacgcctgcccgccgccgtcaagggattgcgtcaggattattgcggcatgtcagtttggtgtacgccgagaaatatcaggatatgctggtgggtaccggagatgctgattttgataatcttcggttttatatgcgccgcgggtttcgatttgattcgattcgcaagcatttttttgatgaatatagtcagccggtttatgctgatggcttgcgattacaggacatgatcgtgttacgccgcaaattgttgttgacgcgtgaggataagacaaaggagtaaggctattggcgaaaaagcgccgacgttttaccttaaagaaggttccattggcggcttggctggtcatcgctttttttgcggttggttcaatgttggttgtcagctcgtattggtcgcaacggcaagccgaagtttcacaacgccaagcaattgtcgataagaaggcggctgaaaaagcgaagaaagaggcttttatcaagcgattggtaccgacagcccaggccatgcagaaacagtatggcgtcttgacgagcattacgctggcccaggcgattcttgagtctgattggggaacgagcacgttagccaaggattaccataacttatttggcattaaagggacggatcctgccaccacgaaagtattacggacgaaggaatacgttaatgacaaatggatcacggttgacggccggtttcgggtttatagcgatgatgctgcttcgattcgtgatcatgccttgctattcgttaacggtaccgactggaatccgcagcagtatgcaacggtgcgggccgcaaaagattataagactgctgcctcggctttgcagacggacggctatgccactgatccggattatcctcagaagctgattcatttgatcgaagcatggaatctgactcagtatgacaattgaatgttcgtattttgttgattattgaatcctcgttatttggttatggtagcgccaaattgcgggggtttcgttcttttatcgctgtgaaagcggctacttagtttgttcgggaattagtgagcttgtattgttccacggcgttttttatggtaagctgattgaaaatttacaaataaaaggagtgcttgtggtgaaattactggaagaccggattaaaaaagatggccaggttattggaacagacgtattgaaggtggacaactttttgaatcatcaagttgatcctgatttaatggctgatcttggtaaggaattctaccggcgtttcagcaatgagccgattacaaagattttgacagttgaaagttctgggattgccccggcgattgccactgcgatgtcgtttcacaagccgctggtgttcgcccgcaagcataagagtctgacgttgaaggatcacctgtacacggcaacggtttactcgtttaccaaaaagacttccaatgagattgccatttcgcggaagtttttgtcggctgatgacaatgtgttgattattgacgactttttggctaacggacaagcagttgaaggattaatggatattattgatcaggctggggcaactttaagcggcgttggcattgtcattgaaaagacttttcaaaaaggccgcaaattgttggatgacaagcacattcgcgtggaatcattggcgcggattcgtgcatttgaagacggtcaggttgtttttgaaccggaggactaggctcgaagatgaagaataaaacaatttccaatccaaaagcagcggcattggggctgcaacatttattagcgatgtattcgggttcagtgttggtgccgattttgattggggcatcgttgcactttacctctgagcaaatgacgtatcttgtctcgattgatatcttcatgtgcgggattgcaacggctttgcaggtgtttggtaacaaatatttcggcattaaattaccggttgtgttggggtgtgcggttcaggcagtggcgccgcttattatgattgggcagaagtttaacttccaaaccatgtatggcgccatcattgttgccggcctgtttgtttttctgatcggcggcgcgttttctaaactgcgctttttgtttccgccactggtgaccggttccttgattaccgtgatcggtctgtcgctgattccggttgctttccagaatctaggcgggggttcgacgacagccaaagacttcggcaatatgacgaacctgtttgtcggcgcatttacggtattactgattttggccattaatgtctgggggcgcggcttcttgcattcaatcgcgattctggtcggtttgattgcgggcacggtcttaggcgggttcctcggcttagtcagttttcagccagtcattgaggcaagttggttccacgtcccgacgccattttactttggggttccacagtttgaatggagctcaattgtgaccatgattctgatttcaatgacgtctatggttgaaagtaccggcgttttctttgcactaggggatattgtcgggcgtaaaattgaagcagatgacctgaaacgcgggtatcgcgcagaaggcctagccgtggtactcggcggtttgttcaacactttcccgtacacaactttttcacaaaatgtcgggttggtgcagctttccggaatcaaaacccgcaagccagtgatttattcggcagttttcttggttatccttgggttgctgccgaaaatcggcgccttggcaacgatcattccggcaccggttcttggtggtgctatgctggtgatgttcgggatggttgcggtgcaaggtatccggatgctgcaacaagttgattttgaaaatgataagaatctgctagttgccgcgatttcaatcggtttaggcttaggggtaacggtacagccgcatattgttcagttcttgccaaaaaccattcaactgttgtttggatcaggaattttgatgacaagtctgagtgcggtattgttgaactggttgtttaattcaccaagtcgtcatcctgaaatgccggttgatcgcgggttaaacgaacaggattcagacaaataaagtcaaagcgaggaacaattgtgacgcaatttattagtccaggcgcaaccatcggcattattggcggtggcgtatcagcttttcgcatggctgatactgctagcttaatgggcatgcggactgtggttttagcaccgacgcaaacggatattgctttggaaaaagccgatattcctttggtcgggcaagcggatgatcgggaagcattaaaagagttgacgcaactgagtacggtcatgacctttaccgatgaaaacgttgacggcgctgtattggctgaattagcaaccagcagtcaattgccgtcaggaaccgatattttgaccgtgacccaggatcggtacttggaaaaggtctttcttgacgatctcaacatgaatattctgccatatacccaagtcatcacgcctagcgatattaatgaggcaattgacaccattggctatccggccttattgaagccaattcaaaaggggatgggcgtggatcagcagttgttgctggcaaccccggcggatgtcgatcgtgccaaacaattgctgcagcagcgtccgtacattttggaagcctatttgcaaaatattaaagaagttgccgtcatggtcgccaaggccgataaagaaatccgaattgggccggtgattcagaattattttgaacatcatcaactcaaagcatcttcggttcgggctgacgttgatccggcggtaattgttgagattcgccgcattgcagaaaaaattgccaagaagcttgattataatggcattttcagtcttgaatttttcttggcggctaacgggaccctgtacgtcaaacgggttttcccggggccaaaattgtatggtcacctcatgcaatgtaccagcgatatttcggaatatgaactacatctgcgcgcgattctcgactggccgctgccagaactggaattggccgaagatggcgttgcgattccgttacggcaaaaagacatggatgcggttttgacgcagattcaaattaagccggattggcggtttgctttctatccgactggcaatgagttagtcggcgagattgaaatcgttggtgatttgaaagcgataaaagacagtatcaatgccacgggacattttgtgattcagtgaaggttctcgagcgtgtcggctgcatggaaaagtcggcacgctcaccggtgatacgatgatgagtatagaacatggcgcttacaatagaggaggaaaccacctgtgattccgcgttatagtcgtcctgaaatggcggcaatttggtcagaaaaaaatcgttatgctgcatggctgaaagttgaaattttagcggctgaagcctggtcgaaactaggcgaaattccggaagccgatgttaaagctttacgggccaacgccaagtttgatgtcgatcgaatccacgaaatcgaagcggtcacgcaccatgacgtggtcgcatttacgcgggacgtttccgaaagccttggcgaagagaaaaagtgggtgcactttggcttaaccagtaccgatgtggtcgatacggctcaaggttacttacttaaacaggctaaccagattctacgtgcggatttagccgcattaaaagcaagtttggcgaaactggcaaaagcccataaagatacggttatgatgggacggacacacggggttcacgctgagccaacaacattcggtctggttgttgccacttggtattcagaactgaatcgcgatattcggcgatttgaagatgcggcaagtgatgtcgaagcaggaaagatcagcggtgcggtcgggacttttgccaacacgccgccagctgtggaagcttatgtgaccaagcagttaggcattcgcgcacaggagatttcaactcaggtattgccgcgtgatctgcatgcccattacattcagacgctgggcctgattgccacctcagttgaacggtttgccttgcagattcgccatatgcagcggaccgaagtacatgaagtcgaagaacattttaataagggtcaaaaaggttccagtgcgatgccgcataagcgtaacccaatcggctcggaaaatgtctccggattggcgcgggtgattcgcggctatgaaacgccggcactagaagacgtcctactatggcatgaacgcgatatttcccactccagtgccgaacgtatcatgctgccggacgcaaccggtttgctagattacatcctgcaccgtttcacgagtattttggatcatctggatgttttcccagagcggatgaaggccaatatgaacctcacacacggcttgatttatagccagcgagtgatgttaaaactcatcgaaagtggtttgagtcgggaacaagcctatgacctagttcagcctaagaccgcgattgcatgggacgagcaccgcgacttccggccgctgttagaagccgatccggaaattatgggccggttaagcgaggctgacttagacgatgcgtttgattatcactatcatctcaagcatgttgatgaaatcttcaagcgcgttggactggcttagtttcacaagtttgctcagaatatgataacgaaaattgacgctagaatttttctagggtcaatttttgtgtttaaattttaaatttgaacgacagtcgttatctggtacgctagcgctaacttttcaaaatcggtgccggtgacaataatcgcaaaaaaagaccttgcaatgtaacttcgcaaggtcatttggtgacggcatgtaatgataagacaggtggttgttgccaagcattttgaggattggcactgagcagcgattgatcggttgtcaggaccaataagcagctttcggtttgttgcaaagcatggttggcttcggttaagaactcgcgggtaacttgcggatcaaaaatctcggcatgaccgcttaatagtaaatatcgttttttacccatcaaaccacgataaaattgcaaatagatccgttgcaacgtgtttaaagtggccgcgggttgatcgagaaccggagaagtattggcaagccattccggcaaaaagtccgtatgcttagtgtgcccattgatgcaaaggttattccgaacactgagataatccaagataccagtgtcgcgactactgatgaaagcaagttgcttgatgaggccaccattaataaaatccttgatatattggtcgcgtaatgcggtcagtgcttcctcatccgggacgtataaatattgaatcgttttgggcgcgaaaagctttgcaagtctttcacgatagatatcaagctgctttgaccgaaataacatagctgtctcctaacgcggcatgacaagccgtttgcgaataatcgaaagcggggttaccaagcctagattggtgacgaaaatcacgccaaggccgtttctcaatgttgtcaagaagccggccggttgggtgaggtcgtccgttttaccgccgtaatagaataaggtttcacgcgtaaagccagttaggtgacgggcaaagagttgctgaaaggcgtgattcatgtcaattccacgatagccttcctgtaaaagatgaccaaaagcagaacgattcgcattggtcagaagctgaatcagctgatcattaaataaaataatcagaaaaacactaatgataaagctgattaagaaactgaaaaatgcttcaaacgcatattgtaacccgatggacatgctgcttttgccgaccaaataaagcgcatcggtttcagaacgtcgcagaaaccacagcaaggccgtcccgatcaaccagcaaacaccattaatgatgacgacacgatttaataatgtttgcgtgatttgcatcattttaatatgggcttggccaacttgcgtacttagcagaatcgtttgtttattttgggcaccaaaagaatttagccgctgtaaaaaagcgctttgtgcggattggtcgatcatttcactcgttatcagcatgatgctgatcaagcagaacgcaactgacagcagcatcatcacaaagtaataacggcgatgataacggaaacccgagaacgttcgctcaaagaaatgcatctacccgttcacctcacaagcagtataagcaatgaatttgaacaaagtgtgaacataaaccgagcattcactatgttatttgattcatttgagctggttattcttgatattgagggtactggagctgctagatgcactgctgctagcggatgaatcggtttgattttgaactttttccggaaaatcggtgatcggtgaggtgtcatctgctaattcaggcgcatcggtttgataaagtccggttgttgattggtcgttattttcgctataaagactcgtgctcttgctgccgcgaccgtgttcaattgacagcacattgctgagactttgattgtaatcatactggctgggattaatcggtttaaagcctaatggtacatagaaacgcaatagattacgattagcaacgtcatcggatagactgagccgcgtgtcgactgatttctgctccttatcaatggttgcttgtaaggctggcgtcatggtgacgagcttgccagtcgtattatcataaactttgctgcctaaaacagtgtacttcggcgtgacaaaaatgtgatttcgaaaagcaacgacattgtcatgctggttggaaagcagatcggtaccaaattggacgtagcgcttactgctgatcccaagcaaatgcagtagcgtcggcagaacatcaatttcaccgccataggtattgttcacgccgcctttaagacccggcatgtggaagattagcggaacccgctgcagttgggcatcgtcaaagccattccagtcactggcatctttacctaacaatggcgctaaggtggtattacgatcgttgctgatgccaaaatgatcgccatacagcatcacgagtgaattcttttccaaaccactggctttcagataattaaagaattcccttagtgcttcatcgaggtagtgagccgtcttgaagtaaccgttgatcgtcgcgtcatcagtgccggcatccgggaaatccgaatccgcctgggtaatataaaatggattatggttactggtcgtaataattttagtgtaaaacggttgctggagatgctctaaatacttcggtgtttctgccagcatcaatttatctttaatcccatattcggtggccgctttttcatcatgattatagaagttaccggaaaagtaattgttatagccaagactcttataaacattatcgcgattccaaaatgaagcggagccgccatggaagacagcactggtatagccagcgcgttgatttaaaattgccggggcgccttcaaacgtattttccgttcccagactgctgaacaaggatccattggcaatcccgaacgtactggtttccagcatattttccgcgtcactggttttgccgagtccgacttgatggaagaaattattgaagcttaacgtgtctttttctttaatcaacgagttcagaaatggtgttacttcttgaccatcgattttttgaccgatcagaaattgttggaagctttcaaggtgaatgatgatcacgttcttgcctttagcggctccgtaatagctagcgttaggagcagcataatgcgaacgcgtgtattgtagaaccggatcgagattcgcactgtctgcctgagcccgtacctgattgttttgcgccgttttagctgcgtcgtaaattgtaaaaggcgccaaaccgagatatttgacgatgtaattacgatcaaaggtccgcgtcagcaactgtggtcgattcatttcactcactgccgtcatcaaagcaaaaaaggcaatgccaaaaaccgtcaccgcttggggcagatggaagggcaggcggctagtatccaacgacagcccaaaatgcggccacttaagccgttgattatggatgtaacgccaaatattccagatgctgtaacctaaataagctaaaattacgatcacaatgtccagaatataaattaaatcgtggggtttgaccatgcttaaagaactggcgccgagtccttggctgacttttgacacaccaagaatcgttgtgaccgtcaagaagtcggtaaattcacgataataaaggatgttggcgagcaataataacgtacttaatatgtagacgagcaggccaatagcgtaaccgcggcgggcatgcttagggtatagccctaatgacaggagaatgatgcccgttcccagcggatttaagatgagtagggtatactgcagcgggtcattcagcccgagcgagaagtcaacgaaatacccgaaaatcgtttttgcccacaataaaaaaagcagcagggctaagaagccgattcgagtattgcgtacccattgtaaaagttgattgagtcgtaaccgtttcaaagcggcaactcctttccactttgttctttgtcattgtacccgcaaaacggcaattgcacaaaaagagacggtaagcgcgagccggcgcggttagaagtcggagtgtaagcggccttatccgtaatggcccggtcttggccattgcggataaggtccttacacgcagacttctgcgccggggagcgcgttatgggcgtaaaagcagactagtaaccttgagcgtgctcacaggcttttgatcattgcgtctaaggttcttatgtacaggttccgggctggtgaacggggaaccgccaatgataattgctgtattcaatagcgtaccgcagtttgccttaacctaggcattgacggctgattcttatggagtctttaaaagttgcaacgcttgtgggtatcacgcgttgtgtttgctacaatggcaactggaggtatcgccatgctttttttggggccattttataactggattaattcaacgtctttgagtcaggtgaaccattttcctttggtgcggctcattatttttagtctggacaagaccatcctttacctattagtgtttgccgttttgcgatgcctctggctggttcgacatcatcggcgaacgacattcggacgcgaactgaaattgggattgtttgtcggctatttgatgctactgtttgcactcacggtttttcgcgatgtgtactatccgtggcaattggtttttcattggcaacgctcactttctgtcattaatctacagcccatggtcgaaacgctgaaattgcggcaggccgccagtcattttgacttatggtatcagtcgttaggcaatgttgcctggtttatgccgctgggctttggcattccttgggtcagtgtgcatcggcggcgcttgtttgccgttgtcgggatcggacttatcacatcattaagtatcgagacattacaattcttgctgattagcggcgttgctgatattgatgacgtcatctttaatgttatcggcgctattttgggatatgccttttaccggttattgcatccaaaaggttaagacggcggtcgtttcaattgaagcagtcaagcaatttttcccagcactaaccgcctacctgcgcgaaaaattcgacttgttttgctgggaaaagaacgatagaatatttttttgtgttctattttcgataaaaagcgcgtatatctgcaggcgcttctgtataaagactttctatggaagaaacccacgttcatctcacgtgtaaagtcgtttatatgaagttttctaagcaggtgtattcgtactcagttaaacgatacgataaagaaagaggcgcattatggtatttttacttgcgttgatcccggcacttgcttggggttccattggcttggtcagtggcaaacttggcggcaatgcctatcagcagactttggggatgacgtttggcgcgctggtttttggcgttggcacgttattgatcatgcatccggttcttgacgctaagacctggctgcttggcattatttcggggttattttgggcattaggacagggacaacagtttcagtctatgaaatatatgggtgtctcaatgaccatgccaatttcaaccggcatgcaactgattgcgaccacgttggccggtgcattgctgtttcatgaatggcatactggccgtgatgtgttgcttggcatcttggcgctggcgttactaattattggtgcgacgttgacttcgcggcgggagcaaaatgatgacttcacctcggaaaccggcgtcgctaagggtttgcggacgttactgatttcaacagcaggttatgccggctacacgattattgtcaatgccggccagcttggtgctttggcagtggtgatgccgcaatcgcttgggatgattattggcgctttgttgatgagtatcgggcatgagccttttgctaaagccactgcgaagaatgttttaaccggactcttgtgggggaccggtaatgtgttcatgctgttgtcaatggcaaatgtcggactggcagtttcctattcactttcacaaatgggcatcgttatttcaacgtttggatccatttacttacttggtgagcataagacgcgtaaggaaatgatctgggtcagctgcggttcggctctcgtcattcttggcggggtcgttttagggatcatgaaagcaaagtaatctgatgagaagttgctggattgcttgcttttttacaaattcaattttaaagttaacttgttagagtgtgaatttgaacagcgtactgcactggcgtaaacttttggttggaagcggtgccgctatttttgatggcgatgccggtttgatcaaaagtttcacggtaaggtacgtatttagaggaggaacgcacacgatgtcgtacatcaaatttgattcatctaagctggataagttcgttcacgcgaatgaacttgaacagatgcagccgttagtaactgcagctgacaaggaattgcgtgaaggtacaggtgccggcaaggatttccgtggttttctcgatttgccagtcaattatgataaggacgaatttgcccggattaaggctgcggccaagaagattcaaggcaattcccaggtctttgttgcgattgggattggcggttcttatttaggcgcacggatggcagttgattttctttcccaaaccttccgtaaccttgatcctgagctgaagttcccagaagtctattttgcgggtaactcaatctccggtacttatttagctgatttgctcgacattatcggcgatcgtgacttctcgattaacgtcatcagcaagtccggtaccacgactgaaccttccattgctttccgtattttgaaggctaagttaatcgaaaagtatggtaaagatggtgccaaggaacgaatttatgcgacaaccgatcgggccaagggtgctttgaagcaagaagccgatgcggaaggctacgaagaattcgtggttcctgatgacgttggcggccgcttctcagtgatgtcagcagttggcttgttgccaatcgcagttgctggcggcgacattgacgaaatgatgcgcggtctcggtgatggtcgaaaagcctatgcatcagctgatttgaaagaaaacgaagcctatcagtatgcagctttgcgtaacattttatatcgcaaaggctacaccaccgaactgctcgaaaactacgaaccaaccttgcaataccttggcgaatggtggaagcaattaatgggcgaatctgaaggtaaagatcaaaaaggcatctatccttcaagcgctaacttcagtactgacctgcacagtctcggccaatacattcaagaaggtctccgcaatctgatggaaaccgttgtgtgggttgaagaacctaaccgcgacctaaccattcctgacgacgctcaaaacctcgatggcctcggctacttggctggcaagaagatgtccttcgttaaccgcaaagcttacgaaggcgttgttctggcccacacagatggcggcgtcccagttatgaccatttccattccgaaacaagatgcctacaccttaggctatctgatctacttctttgaagcggcagtttccatctccggctacctgaacgggatcaacccattcaaccagcctggtgttgaagcttacaagaagaacatgttcgcgttgctcggccgtccgggttatgaggatatgaccaaggaattgaacgcacgcctttaatcgcaagggcttgcgcgttttgaaataaggtaaataaagagctccagaatcatgttagaaaagtccgtggtgaagttttggtgaaggcttcggacttatacacaggttctggagctctttttgtgttcactgatttaggtatttttcgaattgttgatggttttctttcttttttgccggagagatttcagcatagatttgagtggttgaaatgtctttatgcccaagatcatctttgatgtcatcaaggcttaatcctgcctcacgcattaaaacggcatgcgtgtgtcttaaatcatggatacggatgtgaggaagtccagcccgattggtgatgcgattaaaagcaccggtagttgctcgagatcggagcggttgtccaaacttggcatcagacgaataggtgaagacaaaatcgttattgtggctagtagaaaaccgaaaaccttgtacattgccgtgactgaaatggcgctcatattgttgttgaagaagatcatttactcgagcggtcatgtattcggttctcttagagcttaatgttttgggacgatcaagcgctattttgccagcgtttgatccagtttcagcacgatagattcgtgttgcattgactgataaggtatttttgttgaagtcaatgtctgaccagcgaagagccatggcttcacccacacgaagcccgcagtcaatcagcgtcacaaagaatgatagccacatgggctctttatcttcttcagctgcttctataaaagatccaacttgatcttttgtccaaaagtgaagttttttggaattgtctttagcatacgcactgaactcgacaccaacggtagggtttttggtaatgtaaccaattgcaacggctttttttaacgcattgtgcaatgttccattgatgagctttactgtgttaagagacaagccatcattgaatagactgctgatgaactcctgatgttccttaagcgtgtatttggccagtcgaatatccccaattttggggataatgtatttcttgaggttatatcgatagatgatcatggatccctcttttacattaaccttaagcttggtgatccactgattaagataatcagccattaaaattctttcagtttggtagtgagagtggcctctgattatttcggactcagctaaagttgcttcttgctgggctattttttcggttggaaaacctcgccgatggatctttatttcttttcctgtctgcggatcaacaccagcgaatatatagaattcccaggcctttttgccatcttttagtttatatgagctaattgatgccatgatatcgcacttcttttgaactcttagagcttgtaattcaaacgtatgttcgttatgtccttaaaataaaagcctcattaaaaacaaggctccgttggttctaaatggatagattcttttggtagaccgtttgcaacttttatattatgattgcatggaaaggtggtggcatgatgaaggctttcaaaatccaagacgcggttaaactttattcgtcgcttaaaaaaacttacgaacgtgaagactctaaaattcagaaaatgcaagaagagattgatcgtgaaatgaagaaagcttctctgaccaccaaaccaagtgcggaacaccaaggacctaaacgacatttaaaaatacatagagataggccgaattcttaaagaatcctctttttgtgaaatgccaaagttagtcaatgcgattgatgacaagtaacttgcaatcgcaccaatatcacggggtgccaattgagaatttgtaagagtttggtgtttccaatttgtattatctgatttgttttccacgattcccattatataaagggttcgtggatttttttgtagcatttgaagttgtgatgggcttaatctaaaaagagacttttgtgcaaaaacaacggtttgctcagtggaaacaatgacactattcggcatactttttgaaaagaagttcaccattgcataaacacttctaaaattctcttgcgagcttttgtcctctgttatcttttgttctgctttttggattttcttcttcatgtcatctatttgcattttcgcgttgctggcattccttgtccttgcttggataactctcagctgttttttgtaaccatctaacttttcttctgaaacattatctgtagacaatctcagcactggatcaataatttcagggttggtaccggcttcaagagaatcgaagtcgtataaggaaaagctatctttgtaaagtaccaagtctcctggttccgcattctcaacaggaacaaattgtttttttagatagccttcaaggatctcgaccccgtaatcaccgtatactatattctctgaatactgatgcctattatgtgttgaactttcgtctgccatagagtggctatcttcggccgatcctgaaccatttgctatccctgggactccgccgctaatttttgcggattttcttccacctttagttgcgacctgagtcagtatggaggttttctcattcatacgcgtagtcagggtgctcaagccttcgtcaaactgggctaataaggaattcattaagtcggtgtcaacatagatatactctctcagtttcttttcggcttcagcctcatcatgcagattatggtcttccattttattctccttcaaatagtttaatttttagttttgcttcatcgcccacgcagccttccgcggaaggctatttctttgtctgaaaactagcccccctttatgaagtcgtattattgcatctttctaaccatcatcatgagcacgccgataatgatgaaaacggctgccaaccagaggctgctgccgggtttgtctgggtcaatgagccaatatacccaacggtgtttgtggccaaataaggctaagtagacgcctataagaacaatgatgaggccaatgaagtgtgcctcacttaatgtaactggaccattcataagtgcatctccaagaactgagcttagatttcgtttagcttgctgaactcgatgtcattgttgtatctgatcttgacggttagtgggttgcaacggatgatgacgggtcgatcatactgtaacgatttttgaaaagaattgaggctttccgtaaagcttggtatggcctcctcagcggtcaatacaacggcctttgcacgcaatagcaacgatgagtggtgtagctcattgaagcagtaaacagccaccacaggcttctctaggacgttttgaatggtagtagtgtcgcgatcagtgtaaaaaaggatttctttcagcgatcggtgtgatttaagtggtgttagcgaaactatattaggaaaaccggtatcggtatcaagcgtagctacctgcataacggtacactctcttaacagtatatcggcctgcctgatcgtagaatttgccataagtaatactcctatcttaactattaatttgatacgagtagctatgtttttaaccgttgatggtgaatcaaattcatttttgctataattagatgaatattgttcattagcgactagaagggcagtgactaaaatggaaaatcgtgttgagataaaagaaggacatgtttttgtaaatggaaccgaaattaacctggtcaatgatatacagcttcatcctgcgctgaacgacacaacgcaagttcaactgagttttaaagctacgagcctggatgtagtttatcccggatctcggcggtgatgacgttctgaatgattagtacgaaattctttatgatataatcagtgaaagataactagacattcacatagaggagcgatgatgatgaatgaagacaagctaggttatagttattcatatgatttgaaagatggaattgtcaaggtgaaggattttgtgaaatatttagagtctttacccagtgattccacaatcagaattcagggtatttcagatgatcgtccggctgttattgatgacaatgtctattttgaaaaaagtagtgggcaattggttatccaacctgattcattatctatatgatcaccaaaaaactctgtggtggatatccatgattattttgaagcttcgattgaattctacgtctagttctttatccttatgtaccacttgtatagctgacagagtgtaaagttttcctacaagaactgcgagctcatgctcttttttgttgctaataattgcctcatagttatccgtggcaatcgcatcctgataatttgagatgggacagtacccatcgtcgtcaatccagctaatttggaaaaacttgacgacttggtaaacattcttaattacttcttcgcaaagaccctttgttgggattaaagtcccgtgaataactctgttgcgtttttctgtggaatcgtacattttgttcaacataggaattgctgattctccaaatagtagtagggaaatcgttgcaaacgaagcaatagatctttctgaatacttgatagcgtgtgatttatcaatgattttgtccattggtttgtggttgtttgttgaccaaaagtaagctttgatagctgtgtttctgaatttttccaagctcgtaactgcgcttagatagcactcatagtattcttcatcatcatacgctcgtaaagcattttcaaatatcggaacatacagaggggtgcgtaatactgcatgaaatgtatgacccctaggacatataaatttcagtgattcgtcatcagttacttccgcgacagcactagatttataatcgcggcattcggcacacattgtttcaattttcgtgtcagacatctccttacattgtactgaccgtgtttacttggtttgcttattagccctcgccaccggggctatttttgtgcccagcaaaagccccaagtaggggcctgtaaaagggctatttcatattggactgggttttcccgcttaaagcatcatttgtaaaggtcacgttgaagttggaacccagatcaccttttacaccagatgtataaccggccacaacattcttttgaccgccgataaggctttcattgtagtagtcgggttgtccccattttgaggtgaagtcagcgtattttgtaccgtcctggaacgcgttgaaatctgccaaagtaatcttttgcttgcggcctaacttgaagccagtaagattcttgctgaacgcatttccgtcggtgaaggaaacaattacgttagctccccagccaccctcaacattagtccacgttacaagatcagtcttaactccatttgtggtactgctcgaagtagaggacgggttcccaaactgggcttttaaatcatctaatttggcaccaccattgccgttttccatcaaatcacccaatttgatgctgtcaaagtctgctcgagtaatcttgccgctgtccttttttgatgtacttgaagatgatttatccgttttgctaactgcggttttttccgtggattcgctgcttgatttgcccttattgttgaggccaccgccaattgctgctaccacaacaataaccaatatccaaaaccacacacgtttgtaaaaaggcttcttcaccttatattgcttaccgtcagcacccattaccttttttgccattttgttttcctccataaatagttttcagcttttaccgtcttccgtatctggactaacaattaattaatgtaaaattcttttattgcttccaaagcagtgtcttccattggtgcaggaatgtcaaaagcttccataaattgattcaggttagcatcttctttatcgatgtaagcaaagtataagggaacgagaatctggattcctcctatgttagcttcaccttcaatactattttttgatgctgaatagaaatacagacaagctggatcttgatgtagaacgtgcatgatttcgtgtgcagcctgataaggcaattgcttaggcttgtgccagttcatattaaccgcgatccaacgtgtttcaggattagaaactgacggagtgtacggcttcagctgatatgtcagctcagccccaactccacggtcaaatccgtagtttaaaacctctctcagcatgtcactagtaaaatcagtcatcatgtttgccacctcgaagaagtctcttgattatctcaagatcttcaggcggaatggggcgaccttcaaaagtcatgatggtgtcattttttgaatctgatatgtcaatttgctccggctttgagcgaacatcagtaaccccaagcaaaaagtcggtagaaacattaaagtaactggctagtttcttaatagaatcttggtcaggagttctttcgttcttttcatataaagaaacagacgctttgctgacatttataatttttccgacatcagattgggtcatcttcttttcgttcctaagttcttttagtctttctccgaagctcatcatatcacctcataggaatagaatagtgtatacaaattgtaaactcaacaaagtttaaaaaaagttcacttttttagttgacagtttactaattgtagattatagtgtttacataaagttgattaggaggtgatcatttgaacgaaaagctgaaagaacgccgcaaggaatttcatcttacaatgcaagatatttcaaatatgattggcattagcaaaggatattattcattgatcgaacgcggagaacgccgtgtcagctatgaattggcatttaaaattgccactgcattaaaaacaaagccggatcttatttttttggaatatcagtcaactttaagtaaacacattcccgctcagcgagaggaggtgacacgatgagcaagaaagaacacgacgaacaccagattcaaaactgggaagaacatgacaagagacagcttcaaagctgggaagaactcacccaggaaataactgaacatcttaagtctggagaccaaaagctgcaaaatatacacttgacgaatttgtatgacaggtacgacggcttcaaatcctacggaacattgcttgtggctgtgcttgtaaatacaagagacaccccgaaggatgccccgaaagattagtcaccatcagcactttctggaatccagttagtgcctagtgaaaatggatcttcgttgacagtgaagaccgtaaacgaatatccgcgtagtcttgctttttcgtgaacgagggttagcggactgaattgttcggtcttgtctcccatctctgcgacgatcgaaatcactccataaatggtcttcggcaaaccggtctgggtatttatgaaggttacgtcccacatttttatcacctcccttcgatgcaattatcgcactcggcgggaggcaatcacacaatattcagttttcaagttaaggaggtgagtcacatggatcgtaaggacatgattaaggatctgaccacagatcatccagaacacactgcatcttattggtcagcattcgatgacaataccttgatgcaaatcattgaactagatcataaggaggttcaacggaacgtctctgatcaacttgctatgggttaatcatagccctctctagcatgaatcaatatccaccaatatttcatcttttaaaggaagtggaacgtatgaaagcaacaattagtagccctttgaataggttcgctactagaaccaacacgccacagaaggtgatcgcttatgcagcaaaattagggcgctcaacgatcaacaactattttcatggaactcccattagagcaaacgaggctactgacattgccaattcgatgaatgacagcgaactaagctatgaaatggctaacttgtttctaggaatccctaagctgtttagcggtgacggaatataccacgatttacgcgggcttttagtcaccgataaacgagaagaagacgaggagaaagcttctttcatcaagcacgacattgagggccttgctaatgaccccaactttacacgcgatgacgctaaaaacttgaaagcatacgcattcgagaaacttgatagcacagtcgcagatctaaccgaactaaatgctatttgcgaaatgctaggcatctcaatcatggatcttttcagcgaaaggctcccgcattaccagaaacttcattatatgaggaaggatgagcaggcatggaacaaggatttacactgatcgatcccactaagccgcaaaggacacgcaagccctttaagcccaaagtttattggacgccaaaagatgttatggcacactatcaggtttctgccgcgacagtgagccgttggaagaaaaaaggtgctccatttgtcggtcccggtaagacacaacgtgttgagccagaaaagatggaacgttggtttgcacgtcagcagggggtataggcaatgctagaagcaatcttatcgatactgctagacccgagcgcgttgttctggaaattctttattgttggcatgttcggtatcctgatcggtgccacggcggtgggcggatggaagcagtggattgaataggaggaaagcacatgcgagataccaaagagtattggcaagacgtgcacgatcaggtcgaaaacgtgatctataaaggccatgctgatcgcggttggctttggatgttcgaacttagtcaacggatgctcaacaaatgcgcacaaaaaaatcccatggcggcaaccacgggacatgaaaaacaaagcaaattaatttataggtcaagtttatcacgaaaaggaggtgcccgccatgcttgaaccagattggaacacggcggcattgaacgagtatcaaaatcgccaggcacgacaagaggaagagccacctctggattggcaaggccatcgctggttgatggcgagacctaccttgaataccacgacgaactcgtcaacgaatatgacgtcattgacttcttaatgagccttggcgcgactgaatatgactactaggaggaacagaaatggctaatgaaattgtagcaagtgtcaacaaccgcatcactgagatgcagaagaatgaaggcttgaaacttccggcgaactatagccctagcaatgcgctgaattcggcttggctcacgctatcagataacagcaaagggccatcgctgttagataaaactagcccgcaatcgcaagctaaagcattgcttaatatggtgattcagggtctcagcccagctaagaatcaggtttacttcattccttacggcaaagacctgaccctgatgcgctcgtactttggtagcctggcgatcctgaagcgtttggataatgtgcaggatgtttgggccgaggttgttcgggaaggcgataaattccaaattggctctgatcgaggccggacggtcgtcaaagtattcgagccgcgtattgagaatcaggacaacgctattgccgcagcatttgctgtcatcgtcgataacaatggcgttgagaacttcaccatcatgaccaagaagcagattgatcaaagctggagtcatgccaaaaccaaaaaggttcagcaagagttccccgaggaaatggctaagcgaacggtgctcaaccgggctgccaagttcttcatcaactcaagttctgacaacgaccttttacttggggccgtcaatgacaccacggccgatgaatatgacaacgcggaaccgaaggacgtcacgccaaactttgatgacctgattgatagcaagccgaaggaggagccgaaacatgctgcaaatgccaaggaaaccaaagagacaaagccaaaagaaaccagccaaccagaccgagctgagcataggccggttaccgacaaagaagtcgcgaacctcttccagaaccaagttaacaagtagaaactattacagcaatcgcatggattggcagtatcagtccccaacttggttcaaaaagttcatggcttgcgaggccgaggctttggcggaattgaagggcgagtggaagcccaagcgcgacccaacggccttgttggtcggcaactatcttcacagctacttccaaagccgctatgcgcacaacaagtttaagcaggaacatccagagattatttcaactcgcggtgcaacaaaaggacagctcaaaagagaatatcaagttgctgacaacatgattagaactttgcgaacagatcctaagttcaaagagttctatcaaggaaaaaaagaagtcattgtcaaaggcgagatcggtggggtggcttggaaaggcaaacttgactgcttagcggataaccataaatacttcgctgacttgaaaaccaccatggacatcaacaagcgtttttatctaccagaagaacatcgctatggttctttcattgaggcttacaactacccactgcaaatggccgtgtatcaggagctaattcgacagcaatatggcgttcaagccgtgcctgtcatcatcgcagtatcaaagcaggatccgccagataaagcggcggtctcaatgccgcaagatttgctggactattggttggaacgagttaaggaactacagccacgcattgaagccgttaagaacggcgaagaagaaccaaaacggtgtgagcactgtgagtattgccgggcaactaagcatctgactcagatcatcagcctctacgatctggtcgagtaggaggtgactcaccgcatggatttattcaagctaattcgagagttctacattcagcaaagcgttaatccgctaagcacaggacagatagcattatggcatgggctggtttaccaatgtaaccagctaggctggccaagcgaattcaatatgccgaatcgaacacttgaaacgttgactggtttaagccgtcagggcatcgtcaaatcccgtaacgcgctaaagcagtcagggctgatagattttcaaactaacggtgttaaggcaacgacctactcagtcatcgatatttcacgaaaacttagtacgtcagatagtaggcaacctagtagtcaagatgatgacagtatgtcaaatagtaggcaacacggtaggcaacctagtaggcaacacagtttacaaggtagtttacaacctagtaggcaacacagtagcacatacactaaacaagacgagactaaactagacaaaactaaacgacaacagactactgctccagtaaaggcagcagagagacctgctggagaaccgtcatcgtcgtcatcatcaattcttgatatttgcaatttctgggaaggaaacgggtttggacaactgtcaccgttcaccagagaaagccttgttgattgggttgctgacatgcgaaaagcaggatcacctgaacctgagaagctggtcctaaatgcgctgcggactgcggttgaaagcaatgtcagaaactacaagtacgtcaacggcatcttgaaaaactgggaaagcaagcgtcttctcacggttgctgctgtcgatgcaaacgatagtgaacgcaaaacgaatcagcctcagcgccgttacggcaagccagttcggaatgagaaattgcctgattgggctaaaccaggttacaaaccagaacacaaaaaagcgtccgcagaagacagagccgaattggctgagcaattgcaaaagctacgagcattgggcgaaaagaattaggagggaagcatattgctaaacagtgtctcactaacaggccggctgacaagagatgttgacttgcgttacacgcaaagtggcacggagacaggatcattcacgctggccgttgaccgcaaattcaagagcaaaaacggagaacgggaaactgatttcgtaaattgccagatctggcgcaagtcggctgagaactttgcaaatttcactcataagggtgcacttgttggcatcgaaggccgtattcaaacgcgtacgtacgataacgcgcaaggacagaaagtgttcgtgaccgaggtaatcgttgataattttgctttgcttgagtcacgacaggcgtctcagaacaaccctaaatcacagcaaacagccaatgcatcagcagcagcgaccacgaacgcgagtcaaacgactccaaatgcttcacgagcgaataccacggatccgtttgctaataatggccagccgatagacatccaagatgatgatttgccattctgattggaaaggatgaaaacatgtggcacatcattgaaaggcttatgcgtgaaaaaggttacagtatcaggaagttttccagagttgctgggtataaaaatccaacaactatttattcaatcaaaaccggtcaaagcaaagatccgtcattctcaacgatgatccgaattgcggatgctctaggcgttagccttgacgaactgaggcctgataagcaaggagagaagaaatcatgagcggaaattcttatttaaagtctgttagaaaatctataggtttaacgcagcgagaatttgctaggaagatcaaatgctcacaatctcactggatcaaagttgaagacggtttttctaatccgagtatcaagctattaaagcaaatcaaaaaggaatttcctgactttgatctcaacaaattagtctgattaaaaaaatccccagtcgtgtcagcaactggggaccgcgaaattttgatccgttgacaatctgacactcatcttcatcacttcactggtatcgtcgcccagtactgctgatgaactgattcgattgttgtcgcttcattgacgcccacttgcgcacgcatcgatgcacctacaataacgtttgcaggaaacgaggacgcaacaacttcaaaccattacttcacagttagcaccaaaaatgattccaatggaatcacccctttgttaagagtatttggtaccacacaattatatatccatttccattttaaggaaacgttgaaaaccacatttggcagaagccaaaaattgttagcaggaggcaaaatcatgacacaagtaacagtgcgtttatacgagcagggagacaaagtgtggcgcgacttcaaggctgaattacttaagcgctatgaaaactcagcaatgctagacatctcgaaaatcaaagcattctcaaaaatcgagaagcaagagttcaacaaccggattgttgtatcaaagaaagcgattgtcgagaaacgtgcggtagctggtgttgatgacagcgatactttgaaaacttcagtcaacaatggccttgaaaagatttcaaaaaagcgaaaagaagcccgtgccaaatacgcacgcggaattgcagaagcggcctcacaatgtaacacgctgattgacgttgcaaaacggatcggaaagtcaacaacgttcgtgaagcgagttgcaagcgaatttgagatcaagttaccgcgccgcaacaacggccatgaagagatcgtgagccgttagcaatttagcgagtgagaatgcaagaaactacaggaggaatcttcaaatgcaagcaattaaaacaaaaatgatggtcggtgatctggttatggttcctgatcgagtattcatgggcgtgcgtgatcttggcggtgtggcacgaatcatcaggattgaacgatacaacgccagaggagcaagacaagatattaacaagccagttgcttttgaaaacaatgcgcctaaagagttaatcgcaacggttgagatggttgacggcaagcaacgtcaatactatctgaaggacgtgaaaccagcgtgataaggctaacgatacctggcaacccagtaccacaaggacggccgaggttcacgcgaatgggtcatgcttacgacccgactaaatcaagaaactacaagcagcacgttaagagcgtagcgtcagagctcaatattgagcctctaagcggtccgataagggtgtcaatggaaatataccgtcagcttcaaaagtctggcagtaaggccttaataaggcgaaaaaaagaaggcaaagttaggccgacagttaagccggatgtagacaactactacaagtctgtatcggacgcgcttaccggaattttgtgggaagacgacaaccaaatagtcgaaatccatgttggcaaatggtacagcgatcaaccacgtgttgagattgaagcagaagagatcgattaaggagaaaaaatcatgaacaaaaaattgacatttacagtaactgttttagcaggacttatgtttggggccggtgcaaccaccattgccgacaatgtttggcaaggtcaccagaacatcgtggagaccaaaaacaatatcgacaagctgacggctaagattcacgcttcaaaatctagcttgtccgatttgcaacatcagttgtctgacgcgcaggcacagtatgcggccctaaaacagcaatatggaaacgacatggcaaacaaagatgcccagattcagcaaaagatcgttgaaggccagcaagcagttgcccagaaacaggctgaggtcgatgctaagcaacagacaatcaacgaccttacatcacagttagaagccgccaaacaggcaaacaatgacttatcacaggcaatcaaagacgcgcagagcatcaaggactattcagatcaggctgtgaagtcagtcagcgcgaaatgagaggcacacaaatgtacgtagtagcaggattaaacacagaaaccgagtattatcgagccaagtatcaatctcagtgtatccgatggataaacgagaacatggccaagcacacggaatcgcacaacacccgtggtgatgacattaaagtcaatattccggaaccactgattatcaagaaagtagaggacgaaaaatgagtgaagaaaaactgtacgcggtaaagaacgatgatggggaatacttgaccgttgagcgtacggcaccttggtggaacagtccggtaggaaccgctgtaagaaatattgatgttgcgcttgcatgggcggaaaagtatggcggccacgttgtcacgttcgttgaggagcctaaaaaggtagtcctaaccaaggagcaagccgaaatcgttgaacgtgcacatagcggcaagttcccagcagccagcattgctttctatggcgatgatgacgaagagccgctgatgaatgcttacgtcaacggctacaccgtggcaaaggagaagaaatacaacgttaaggtgccacataccaaagaggtttggtattacaagtccggcgatacagatttgttaacgatttgcccagcggataaagaacttcgtggcaagttcaccgaagcagagatcgagcactacggcttgcaatactgcgaaaaagaagaggtgactgacgatgacgaataaagccgacatagacgctgcgcaaaaggccatcgatgccgcgaacaatgcgatcaacaaacttgatctgtgtggcctgtatgattgcgcgtggcaagcacatgatggctatcaacgcatcatcgattacaacaaggaacagttggaggtgactgacgatggcattcgttgagcttgaagacggtagctggataaacccagctttcattgaggagatatacaaacgaaaccccagtgataccgtatgggaagctggtatgaaccatggagaagctaccacaataactgacgcagatcgcattcttattctcaaacacgcggggttcgtgagagctagaaaggagaaagacaatgagcaatgagacgaagcaggacgtgttcgagaaggcactaagagaatgggacgattatgttcacagttggggacttcaaggagaagaagcacacggtggatgcgagtttgacccaatcttaattaaatatatgaaggactatgacgccgccctgccagatgaaaccgaaaagcagaaaaactgcccatattgtcatgaaaccgacccacaatcaaagcatgcacattacggcaaagctatttcagataagacagaatatttcgactttgttcgcaaaacgaagctgtacagacgggtgaaggcacgaatcaaatcaccagaagaccagcacccaaagttgtgtgtcacacaaatgaaccggtttagagaagtatcagtcgttttggataaggcaattaactattgcccaatttgtgggaggaaattatgacagagacgaagcgggacgtgttggagaaattagcagaatgctacgccgaggtttctgacgcatataccagcgaaaccggaagcccatactactgtggcgatgagccaaattatctggaggaatatggcacatccttgccagataatctgccggttattccgaaagcggtaggcgatgtgattgtaaaactcaaacacaaaaaattctctctatccggagcgatgagctacgccgcagtagtttctttatctccatggatgacgtttgaacatgaggacaccttcgcccttgcatgggtgctaggtgtatggcgcgttgagaaaaccggcgaaatcgtgaaattggaggcggaaaaatgaagttagttaaaggcgacatcattcgaaacccgtgggtgagcgacccaaaatggcgagacttcattttcattcggcgcgggaagaaatatgtgcacactttgagatctaatcgtggactaattgaagacgcaatgtttgacaaaaaagacgtggacgagcgtttcacaaaagtaggccattcagttggattcgacaccatgctgcgagaagtttctggcgaggaggcggagaaatgaaacgagagattaagttcagggggaatccggagctattggagggaaagcaatgaaaataagtccttaccgtttcatgtcatggcttggtttcatattagctctggcgtcttcatttttacctgcaaaatatatgaattttggagcttacaaaacatttactggtttgacactgatagcagtcttgtttgcactttgggacatttcggatgcaatcagagagaagcagaaatgaaacagatgattgccgtcatgctgctcatcgcaggtgcttcaatgtggatgtgggctaactggaaaagagggaaatgatcgtaaacaaaaagcgcgtctgatgaaggacgcgccggaggccaaacgtacgattgagagtgaatgaaatcaaagattaggagttggcctccaatgacagtatagcaaacgcacatgttgaacgcacgtttaaggcatcaaaaaagcgcaccacgaaggcacgcttatccccaaaacttttacaaatttaattataccataaggggtggcgcttgtgatggagcttttatcaattagcgatgaaaaggatcgggaagcagtcgaaaatatcctaaataaataccgagcagagcgtggattcataaaggcgccagtcaatccaaagatcactagtgcatggggagacggaacttctgccagcactgttcagcgtccgctgtatgcacagcagcgtttggaaagacaagaatcggcacgtaagttctgtgaatggtgcgacagttgtattgcatcaatgccgaaacaatcacatcagcgtttattaagggtgcgctattgcgatgggccagaaacagatacgccagacggtgatgcaatgaatattctcgatatatctgcagcaacctacacacgcagaaagaaaaatgcgttgttagcagcggcctggtactttggcgtcacacccagaaaaagtagtgagcaataaatgatcgatgaatgaggactatttgaggactaattgattgataaatgagtggcgaactaaaaacggaatcccttatgattgtattgtgccaaaggtgagaaacctgagacaccgcatttttcctccgagcctcagtgatgataaagctgtggcaaggcgtggcaatgaggactgaccgtgatagtcaggcgggttcgattcccgcatgccacattgtccagtttagcgaccggacacagcttgcgatgaccccatctgacactgggagagcgagcaaatcgctgtggcggaataggtagacgctgaattcagtgagatcgtcgtgtacgataaagcaagctcgtacatctgaggattcgattatgttgggtgcaaatcccgaccagcgatattaccggtaaagcccggcgtgcttgctagcgcggactagtgggtgagtataaagcgtggtcacataccttgcacttcaaggtaatgtgggaaccaccgaaaccgagggctcagaaaccatcgcctcggatagcagcaaccggaggattaactttgtggcctctattatcgggttcgactcccggcggttgcattggatcaagtctggtaaaccacatgagtaggcaccggactatggcacttcgctaaagtgaggtgctatttttgtgcaacaaaaaagccctcagagaccagtccaagggccaaaagaatgaaaaaacggaatacttgtgtgagcagcagcggttgacttggaggagaaaggccactgctcacatatatatattagcacattccttatagaagatactaaaatagccctcggttgggggccgagagcctaaagaaagggtattacaaaggagtgaaaatgagtatctgttgggaacaatttaattctaactcatcgaaattttttaagcaacaaaaaagctttcggggcctaatccgagggcttaagaactcgggaagttcttcatgagaatgtgagcagcgtcatcaaactgctcacggacattatattttcggaggcgagtagatgcagtggacagatgaacaaatcagtgacattaggaagctcgcctctgaaggctttaccagacgagagacggcagacaagctcgggattagctatgatgcgcttcaaggtaaagcaaaacggcttggcatcgagttccaaaaaccgctaaagaatgaatacgattcagacggcacacagtccagtgaaaccattctaaaagttgtcaggggtcacaaaatgacgcctagagaggttttagaagctcacgggtatgattacaccaagtgggagcttgtacgtgccacaagcaatttttggaagcagacgcctgaagcgacattgtatcaaagcaagatacaaatcaggccgctagttgaagcagaacaatatgaatcattgatgaatgacatcatcacacacaaggagccgtatcaagctaaggctcctatttttgtggaatcagatcgctatttggtcattcctgcttttgatacacatttcaacggccacacattcgacctatatgctgaatcgcttaaacggcaactagagatcattcaacgcggccactacgccaaaatattgctcattctgggcggtgatcttgctcatgtggataatatcaactcgaccacagcaaagggcacacagctcgaaacaactgacctaggcgagactgtgaacgaaatggagcaatacttcgagacactgattgaagcaatcattaagaatgccaatgagtgtgaggtcatgtatgcgccaggtaaccacgacccgtcagttggatatatgtttgcacgtctattgaaacgtgcctacagcaaccagtcgaacatcacttgggatatatcactgaagcattacaaaggcacaatgttaggccataacttcattggcgccactcatggtgataaaggtaagaacaactaccttgcaaaatatcttgatgagttcggcttcatgttaggcacagcacagaatcgcgaactgttcacggggcatctccattcagagatgagcaaagacctaggcggattcgttcagcgtcaagtatcaacgcggaaacctaatgaccgctggactgatgacctcggggttgttgcccacaaaacgtttgagctggtcgaatattcggatcacaatacgacagccatatattacgtttgagaggtgattatcatgagcgaaaaggaaatctggaaagacattgaaggttacgaaggtctatatcaagtcagcaacatgggaagggtgagaagccttgctcataaagataagtatggccgattcacaaacggaagaacgctcgcagactggtgcaatagccgcggatatcacatggtaactctatatcgagacgggaacgctaaaaaatggtgggttcaccgtctcgtagccactacgttcataccaaaccaaaacggatatccggctattaatcacagggacgagaacccaagcaataaccgagtggaaaacattgaatggtgcacagtgctttacaacaacaggtacggcactcacggaaagcgcatagcagaagcacttgaacggccaatttacgcaataactagttcggggcatcgctatttctttagcagtgcaacaaaagcagcggaactcctcgggctaagcagagggaacgtgtctacgtgccttcacggcaagcgtaagcactgccatggcttttcttttgaatgggcgggcgaccccgatgactagagtatggaacactgactacggaaatatgtacgatgttgaatttcggatcattgagaaactatcgagagaagagaaacacatgaacgcaattatctatacgaagccgcgctgtcaaaagtgccggcgaacagtattaaaactgtcacgtgtaatgccagtgcaaacagtcacagcagacgcggacgactacgaacggttccgcaagctgggataccgatcaatgccagtcgtaacagtttacaaggcagacggcacacatgatgaatggtgcgacttgcgggttgacaagatcaaacaatatacggaaggctaagagcttgtacaaatgcgggaggtgtggtgatatgtaatgcgactgacagcaaaacagaagaagttcgttgattcttatattgctgatagcaatgccaccaaagcggcactagaagcaggatacagcaaaagaacggctagatttgtcggtgcagaaaacctaacaaaacctaacattaaagctgccatcgatgaacgcatgaaacgcatcgagtctgacaagattgccaaggctgctgaggtgcttcaatacttcaccacagtgcttcgtggagaggcaaaagagacgattatagttggcactccagatggcgcagaatctgttgaaaacgagccaagcatcaaagaccgcatggcagcaggacgcgaattgttaaagcgttaccctggtaatgatgagctgctcaatgctcagctaacgaagattattactgatattgagaaagctaaggctgatgttcgcaagtccaaagctgaggctgacatcatggaagccaaggccaagttgcttactgatacggattcgcaagataggacggtgattgtcgatgacgtcccagaagatgattaagttaagtaagatggtgcaaccacatttttatccgttttggcggtcaaaggcaccatatctgatactgaacggcggtcgtggctcatttaaatcatcgacagttagtctgaagctactcatgatgcttaaaaggcaagcacagcaaggacataaagccaacgtcatcatcattcgagagaacacgattaacttgcgtgattcggtttacagccagatcagttgggccattgacatgctcaaaatgacagacgagtttgtgttcaacgtatcgcctatgcgcataacgcatcgtggaactggtagcacattctacttctacggcggtgacaagcctgaaaagctgaagtctaacaccgttcgtaacgtgattgctgtgtggtatgaagaagcagccaacttcaaatctgctgaagtgtttgaccaaactaatccaaccttcattcgacaaaagtcaccgtgggttgatcaagttcaggtcttctacacgtataacccaccgaagaatccatatgactggatcaatgagtggatcgacagcgtgagaggagacccggacttcttcattgacacttcaacttatctcgatgatgatcttggattcactgacgaacagcagctgaaactgatcgacaagtataaagccaacgactatgactactaccgttggctttatcttggcgatgtgattggattaggaaccaacgtctacaacatggatttgtttcatagactggatgaggtgccaagcaacgatccaattaggcgtctcgtgttctcaatcgacgctggtcatattaatagcgcaaccacgtgcgtggcggccgctgttacggccaagaacaacctgatcgtactagacacctattactattctccagctaatcagagcgtgaagaaggcaccaagtgaccttgtgccagagataaagtcgtttattgataaggtaaggtcaaaatacaatcatcccgtgcttaaatacacgattgattctgctgaaggtgcgctgagaaacgagtttgttaaagagttcggcattcgctggcatggcattgtcaagggcaaggaagctgacatgattgactttgtgtctaacttacttgctcaaggacgtgtgttctacttggacaatgacgacaacaagatattcatctcagaacatcagcaataccagtgggatgagaagaccgcacattctgacgatccacacgtaattaaagagcacgatcacacggtcgatgctttcaaatatatggtaatggacaacgccggacagttgaaacttagccaggccaacaaggcacgagcattcaagaacacaagcaaatacttctaaggaggtggccatcatattaacagttcaaggtaaaggatcaatcacagacggtgacgtatttatttttccagtagacacagctattactggggacgatatcaccaatttcattagcgcaaatgatgaactagctcgcagaaaatatctacctgctaaaaagatgtatcttggcaagcacaagattcttcatgaagatgccaaagaccacgggccggacaatcggcttgtcggcaacttggctcactatatcgtggatacctacaatgggttttacattggcattccaccgaagatcacgctcgacaacacacaggataataccgcgctgcaagagtggaacgacacaaacagcgttcaggacaaattaagcgaaatcagcaagcaagcagccatttacggacgggcacttgcttttttgtaccaagacgaagacagcaatacgtgcattgcatacagttcgcccatcaattcattcattgtctatgatgacacggtagcacacaaagccattgcatttgtcatgtattggcatgatgaagacaacaatctaactggcaaggtgtatctgaaagacggtatatacagccttgatatggttcgctttgaaggaacggccggatttaatccatttagcgagattccagcagttgagttcttcatgaacaccgagcgtcaaggcatctttgagaacgttgagacgctaattgatgcactggacaaggtgctaagccaaaaggcaaaccagaatgaatactttgacaacgcgtacttggttatcaggggcatgagcctgccagaggatgatgacggaaatccaaagcttgatcttaacggcaaccaaatcatctattcgccagatgctgactctactaacggtgtggccgagtttctgaccaagcctgatggtgatgccattcaagagcaccttattgaccgcctcatcagcatgatctatcagataagcatggtggccaacttgaacgatgaagcattcagcggcaatagttctggcgttgcattgcaatacaaattgctaccaatgcgcaatctagcggccaatcaagatcgtaagttcacacagtcactccggtccctttacaagatcgcgttcagtgttggaacaattctgccagaaagtaaagccgatgaatggcaaaagcttaacttcgcattctcgcgaaatcttccggagaacattaccgacgaagcagacgcggcttctaaactcaaaggccttgtatcagatcagactatgcttagcaccttatcatttgtcgatgatcctaaggctgaaatgaaacgcattgctgatgagactgccaagaaagcaaaagatgctgctgctaacagtccgtcaagcccggacttccagaaattgctgaatggtggtggcaatgatgacaacaacgactcaacaacagatagcgagtaattctgcctactggaataagcgaactgccgctgaacgtaaatggattgccgagaaccttaagaatgacgaggcgttcaatgcccgaattcaggaatattttgacaaagctttaagcaacattcaaaaggatattgattcagagtttgccaagtatgccgcatacagcaacgacagtatggccggtgcgcgtcaagcagtgatggccaccgatattaaagcatatcaagcagaagccaagcggatcgtcgatgatgccagaaagatgtacaacggcgaaccgctcaaatattccgacttcagcaaggatgtcaatgatcgtctcaagctatacaacgctactatgcgcattaatcgcttagaaatgctcaagagtgagattggtcaagaaatgcttgatgcacacatgaaagtgaacgtcgatttaatctcaaaattgagtgatgattatcaatccgagatcaaacggcaagccggaatacttggagagacggtatctaagggcggctacactgatttagccaagttactctccaaacgagagggcgattacaccttctcacagcgcatctggatcaaccaagacattctaaaggctgaactggatgaactgctgacatccgccaccattcaaggacagagtccactaaagattgctcgcaagttacgcggtcaagtggcagaaacggtgaacaatcaccgctatgtgacagaacgaattgtacgtactgagtcagctcgaattcagacacaggcgcaattagatagtttccacaaatttgactatcagtactgcaaatgggtggctgagccaagcgcgtgtgatgtgtgcaaggagatttcagaaggtggcagaactggtgaaggcatatacagggttgatgatgtgccggatattcccgtccacccaaattgccgatgctccattgcggcttatgcaccgagtgatgaagctgaataatttctaagccgcagctagcggctatttttatgccatcaagtccaagcgtgatcgactataaaagctccggtaaattaagacgcaagcctgatccgtctaaaaagctgtggaaggagttcttaacatgattcccaagattttaatgcctatgaatttgcaatttttcgctgaagataatcctcaaggcgatccgaaagatccagtcgatccgcctaagccaaaagatggtgatccggtagatcctcctgaaggtaagaagcaaggagaaccggctgaccctgatcctgatggtaagcacgtctacaccgatgaacaggtcaatgaaatcgtcaagaagcgtcttgctcgtgccgagaaggagaagcaagctgctgttgacgaggctgcgaagctggccaagatgaatgccgaccagaagaaggattatgagcttcaaaaggctcaaaaagaacgagatgagctaaaatcacagcttgccacctatgagatgggaaaacaagctcgatcaatgttcgaagatgccaagctgtcggtcacagaggacgatttgaagcatgttgtaacgcctgaggcagaatcaaccgagaccaatgttaagtggctcattgcgcacgaccaagccgtagcagagcgcgtccgtcaagaactgctgaaaggcagtacaccattggacccgtcctccaaccgcaagacgaagagccttaaggatatgactttgctagagcgcagcgaattgcaacgaaaagatccagagatgtacaagaaattactaacaaaatgaaagaggtaaataaatatgccagaatttagtggtgcaacagccaaattgaatttggtcgaacctaaagtattcgcggattatgtcttggaacagcaaactgctactaaccgtctgctctctagtggcattctcactaccgacccaatcattcaagcgcaattgctcaagggcgggacttatgtaactattcctaccctgcaaagtcttagcggggaagctcagacgtggaacgacactagcgacattactgtcggcaatgttgacagttacagtgctatcgctccacaaatgtaccaagccaaagcgtttgggtacacagactttggtcaactttccaccggcgctccggttgcagaacaaattgcaggacaattcgcatcattctggaacatccaggacaacaagcttctgattgcagtcttgaagaacgcattcctcaatgcggatttgcaggctgttaaggcatatggcatgggcacgccagcgcctttggctgctggtgactttattgccgcattgtctcgcatgggtgacgttgccagccctcaactgacgaagatcgtgctcaattctgctgctgttggtgcaatgcgtgatcagaacctgattgatactattcagccgtctaacggtggtacgccaatcagctactacaacggcattgagatcgttgaagacgatgcactgccagttgcagcagatggtaccacggacgcgttcatcattgctaacggtgctgtttcttatggcttggctaatccggaaaacagctatgaagtcaagcgcgacagtcttggcaatggtggccagactgcggttatcaatcgccgtactcttgcaatgcaaattgcgggtacgtcattcactgatgttactaaggttgccggtcttggctacagcgcaatcaatgcttctgaaacatctatgtacgatctggttggtgatcctcgcaacattggcatcgttgactatcgcttcacgatcgacaagaagttcgttgttgctggaatcaatgccccaaaagcgtagcgccgtctgggaatgacgacggcttcgaccctagcggagatgtcaaaccaacgagcgatcaaaccgttgatgagatcaaagcatggctggacgcccacagtattgattacactgggaagactttgaaggcagacttgcttgcgcttgtcccttcagactagcttgaacaccgtcgcttatgaaaatcacagtgctgcgaaagcagggcggcggaaaggaggcataacatggctgatactgatccggtaacgcttgcggatttgaagacgatgatggaaatcaaaactgacacacaagatgatgtgcttaccctcattatcaaaaatactacgcaggccttacgatttaagctcggcttgcggacagatgaggcctttcctagtgagttggcctacattgccttggaagtctgtgtgcgacgatataaccggcgtaagaacgaaggcatgacgtcttatgagcaggaggggcagtcgttcacgttcaagtctaatgacttcgatgattttgctgatgacatcagcgactggaaagaagccaacggtaagaatgccaagtctcttggcaccgtcagcttcatttctggctatccaaagaggtgatcatatgcggttagatcatgaggttacattctggcttgatgatgaagaatataatccgcaaacacatcaatacggtgatgtgaaaaaggttgccaccgctgttgccagtgtcaccgacatgggaaccgacaagagcgctcagctattcggaaactatgctcaaaaggcaaaggtgatccgattagttgagccaatcaccgtcaattggagctatttaacgattgatgatgaagcgactcattatgcccttaatacggaccgcgttccgcttcaaaacgctactttgattgtgggtgagacgaaatgagcaaagccagcattagctacaacatggagataaaaggcatggacaaattggtagcgggtctgcttagccgagcaaagatggatgttgtcaaacaaatcgtcaaacagcaggcagcacagctccagacacgtgctcagcaaatgactggcaccgtgtacgctcatcctactggtgctaccaagcgcggcatcaagttatcgcttgaagatggcggcctaacgggcatagttggcatgtcgatggaatacaacccatacaccgaaaacgggacccgtttcatgcgggcacgtcctgtattgaagcctgcgttcctttatcagaaagttcagtttattaatcagcttaaacaagcagcaaagtaggtgattcaaatcacatcaccagagcaagaactctacgattatttctatgcgttttcgcaatcatctgggtacaagacttacgaccatttgcccatgcagcaggagaacgccccgtatcctttcgtcattgttggcgatattcaagttgttcctattgcaacaaagacgtcactcaatggcaatgtgctaattaccattgacatctggggcgataaaaaacagcgtttcaccgtatctgatatggcggagcgcttttttcgtgccgcgattgggcaagttctaacagatgattaccgattttatggacgtgtagaagaccagtcaaaagagtttacacaagaccagagtgtccctgacacggttctcaaccgagccacgctgatactcaatctcaatattttataggaggccataacatggcaaatgaattaaaagtgctagaaggcatggacgttgttgccttggctcgcaaacatagcgatcaagcaacggttagcggccaaattatcccttggcagacttcgctgtcctttgatccgtctgttgacagtgattccactgttaccaaggacggcaatgtagcaacacgaagctctgcaagtaccgatcttgaggtcgagttcctgaacaacacggccgcaattgcagacgtaatgtatgactcgctgtttgatggtgaattgctcgacttctggattctctaccgcaaacgtaagaacgctgatggtaagtattacgcatggtatatgcaagtaaccgtgcaagaagacagcagcgacaacgatcctgacgatcactcgactcgtgatgtgacattctcagttaacggtacgcctaaacgcggctggactacgctcgatgatgaaactcaggaacaggttgattacgtgttccttggggtcggcaaggtcactgacactgacaataccggcggtggcacagtttgggacaaggctgttgatccgggcactaacactgctgatactgcaccagcgggcggaactggtactggagcataacagcataagagacttgtcatcagtcgcctaagaaagtcacagtacgggtgaaacccgggcggctttaaaagaaaggactttaaatcatgcaattaaccattaacggtaaagaatatgaactcaactttggcgtccgctttgttcgcgaaatggataagaatatgggtgccgtcatgcacggcattaactttggcatgggtgttgcaaaggctctagctggtctaagcgcatacgatgctgctgttttatcagacaccatttattcagccaccgtggcatctaagaaacgtccgtcagccagtgaagtcgatgactttattgacagcaattcagacttagattcgctatttaagcaagtttcagacgaaatgaacagtgctaacgcagtaaaagcagtagcaaaaaacatgaaggcctagatgaggacgaaagcgttcaaaagagtagtgaagaaacgtatcacgaaattttgttaaacgcatttgcctatctaggcttttctaatattcgagacattgaacgtatgacacttgttgagtatgagctgcgtatggaagcctatcagctgaagcaagtcgacagacagaacgaaattgcacagcaagcatggatgaaccagcaagtgcaggcaaccaccggtagcaagaatcctaagcctaagttcaagacatttgatgatttctttgataagaaagcagctattgataacgtgcgatcaaattatgagcccaattatgaagtatcacagatgagcaaaaccgagctcaaacaaaagagagcacaagtgttcgcaaaacggatggccgaatttcagcggttgaagcgcgaaggcaaaatcattccgttatctgaaagaaaggagggagcacatggctgacagttttagcgttgaagcaattttatctgccgttgaccgaaatttttcgggtactttcaagaacatcgcgaattctgcgtcaaaggtcggtgatagctttgaaaagtcaacaaaaccagcaggcaactttgtgtcaactgtgagtaagattgctggtgccattggcctaactaaagttgtgggtgccattggtgcaggcgtcaaaagcatggctggtgaacttgacgcttccagcaaggcgtggcaaacgttcgagagcaacatgaagttcctcggcaaaacgcccgcagaaatctcaacgattgaaaagtccttgcagagttacgcacaaaagaccatttacagttcatctgacatggcttctgcctatgcacagtttgcatcagtaggtgtaaaaggagtcggccgccttgttaaaggtatgggcggcctggctgctgccactgatgatccaaagcaagccatgaagacattgatggaacaaggtacacaaatggccgctaagccgatggtacagtgggctgacttccgcctaatgcttgaacagactccagcaggcatggcagccgttgctaaagcaatgggcatgagtacaaaagaactggttgagaatgttcaaaacggcaaaataagcacgcagcagttctttgatggtatcgaaaaggcaggcaacagcaaagctttccagaagatggccacaagttataagactgtcggtgaggcaatggacggccttcaggaaacactagcaaacaagcttcagcctgcttggcaagcaatgtctaaagtcgctgtcggagctattagcggcattattgataagatcggaggcattaacttcgattcagttcttgcttcaattggccgcttcttttcaccgttttcgaccctgatcctgaacatcaggactcagcttagcaacctaggcaagggcgaatcaatgagtggactcagttcgatccttcaagggatcggatccgttcttcataccatctgggacctggtcggcagcttagctaatgttgcatttgtcaatctgattggtattgctcaaaaagtgggtgatgcgtttaattcggtgttcggtggtgggcagctttcgggagttttcgatggtatcaagcaagccgtcactgactttggctatgcagccatgggagccatcacaactgttagtgatattattgctaacttaccgtggaaagcaatttttgaaggtgttaaggcggctttaactggtgttgttaacgtgctgaagccaattgcggcactcgtcaaggcggcatttgcaaatgacattgttaagtcgtttgcggtagcgatcctaggagcagtgggagcctttaaggttattagtttggccgttggaggattgtccagtgtcatcggaatcttttcgaggatgatcggcccaattcgtggtgttatcgctgttgttactaattttggaacaattgcgaaaactgctggcggtatttggaaggctttcggattaatattgggaatgaatccgtgggtacttttgattgctgggattgcagcagtggttgctggtctggtgtattttttcactcaaacaaaaactggtcaaaaactttggtcgggatttgtttcgtggttacaaggagcttggcaaggacttgtaggagttgcgcaaactgtttggaatgctatatcgggtgcgtttacatctgcaattagcggcattcagacagcttggagcggcattacaggtttcttcagcaatctatggactgggattacgaccacggcatcagctacttggacagcattcacaaccacactctcagttatctggcaaggtgctgttaccgcagcaacggcagtttggaacgcgctatccacattcttcacgactctgtggaatggaatagttgcagtagccaccgctgtatggtcaacctttggtggttccctgacgacaatttggaatgggattgtccaagttgctaccggtgtttggaacatgcttaaagcagttattatgggtcccattcttattgtcattgatttgcttactggaaattggacacagttaagtgctgatcttcagcttatctggaacagcattgtttccgccgctggtcagatctggaatggccttgttacgtatttctccggtatttggagccttattcaaacttatgcaatgactgtttggaatactttggtttcagctttagaggggctttggaatggtgcagtatctgccgcttccgctatttggagtgcgctttcgtcattttttagcggattatggaatggtattgtgtctaccaccgagggcgtatggaacggtattgcttcattcttatcaggactatggagcggaacagtcagcacagccgagggaatttggaacgcacttcccggattcttttccggattgtggaatagcattacatcattcttttcatcagcttggagcaacatacagtctattgtgattggagctgctactagtatttttaatggtgctaaggctgtatggtctggttttactggcgtggtaagtggaatagttaatggcatcaaaggagcattcaatgcacttcgtaattttagcctggctgacgctggccgcgctatcatggatagctttttcaaaggcctcaaagcagtttgggggaagatcaccgattttgttggcggaattgcttcttggattcgcaagcataaaggcccaatcagttacgatgccaagctgctcatacctgctggtagcgccatcatgaacggcttgaatgcagggcttactgacaagttctcaaatgtccaaaggaacgtttcgagcatggcacaagctattgctgatagtgctgctgttacgatgccggcagtgaatacttctccctttgatgcatcattgcagtcgctcaataacagcgttcaaggtgcaaccttgtcttcaaatcttgatgtcaactacactcgcaagcaaacgattgaggttcctctgtacattgacggccgagaggttgctcgtgcaaccgcaaacccaatgcaaacagagctcagtcgcatgacacgaatgagcaatcgacgaaaggggatcgtttaattttgtatgattttagagagacaacgccctttacgggttctgatgacaaccagcgcccagcagaggcgatgctaatagatggccagtacattgaagacttgattccgggttatagcacgctgcaagtcagtggccgagaactactaagccagtcaatcgagaaacaaacgattggcaagtcagatggcgagtttatccagtatgttcggaacccttctcgtgagattattgtcggctacaggctttcagcagcggacaatctttcgttccgacaagcattctataagctcaatgacatacttcacggtgacactcatcaggtttcgttcaatgatgacttgtctgtgtactggaatgccgtgctcacagatgttgacgatgttcctaaaggccggaatgcgatcacttcttcatttactttgtttgtccccgatggcattgcccactcggtagccacgcagacgtttgacaatatgccttacaaggatatcccgctgaaccttatggcaggcacaagcgctgacccagtatcagtcacagggtcgggctggaatattcaaaagcttggatcgttcaacaatcctaccgttgggaaaaagtatgcagctacggtcttgcttgggcgggccgattttgctgtcagtttccaactttgggcgaatgatatcaatggcaatcggatatcactggctgggtttcccgtgaccacacaaatgggagcaaatcagcgcagcacgattgtctgcacatggcctgacccggggacgactggagcagctcagattgaggtgacacttgcgtgggccttccaaaaaacggatgttggcacctatcaatatctcaaagccaagttagaggaaggcaccacttactcaacatggtcgcctaacccagctgatcctgaatactattccgacaccattacggtgcacaatggtggcacttatcctgttgagccagttatcacggcaactatgcatgctgataatggggttgttgcttttgtcaatgatcaagggtcagtcttgcaatttggttcgcccagcgagattgatggcgttgtgcggcagaagtctgaacgggtatactattttgactttgaaaatgaacctaatggcattgtgatgaatgatggcgcgctgacttatcccaactatcgcgataatccggctacccccaataaacaaaaaggcattttctcttatggacgcccagacggctatgacaatgcgattgcttaccccaacacggaacgtaatccctctaactattggagcggaccatcaatgagcggaaaacttgctgctaattctaatggcaaacagaatggcaactttgaatggcgtaatctaatccgctttgcaaccatgacaaattgggctggacgagttgaattcaatttgacttacgaaggcaaaatcgttgcttcgttggcactttatgaccaaagcacaacagatgaccaagttatgttcgaaggcaagatacatgacggaaacgatgcgcgaatgctatttcatgaagcgctaccacgtgacctctattcaagggcaaacagtttcgccgtcatttcaaaaatgggtgaccagttaactttccgtattgaccgggttggtggtggcaatgttattcggccattcactattgctgggtttggtgcattgccagttgatggctggacagtatggttctctgctttctcagatgttctcgaagccaatatgggctggcaggacagttattttgattgggtaaacgttgactattggacagacgtacctaaccgattcaaggaaggcgatgtggtcaagattgatgtggctaaacgggttgtcagtctgaatggtgctgaagaccctactttacagactgtcggtaacaactgggaaggcttccagctgctgccaggcaaaaacacgattcaagtcttgcagtctgattgggctaaaccatacacgtgtcaagttgaatggcaggaggcgtggctataatggatttttatttcactgatcgttcttggcacttgctggggatcgccacagctggtgaggggccgattcatattgttaatgatactgatgatcaactgatatcagctggtgcgcgaacgtattcaggcaccattttatttacgccagaaacctcagctaaggtcaaatccatggctgcttatggcaattatgtcttgtacaaagatacgcggggtaaggctgttttcatgaccatcatggaatcaaaccatgatcctttactgggtgagaccactttcactgctgaagatgccggcattgatcttatcaatgaaacggttggtccgtacaaagccgataaaccaatgagtattgctgaatacattaattttttcgtgacagattccggatttgatattggcttgaatgaaattccagacttgaagcgaacacttgaatggactggtgaatcagatacagcactggcgcgaattttgtcggtggcaacgcaatttgaccatgcggaattggagttcagctttcagttgaatggtacctcggtggtacagcgactcatcaacattcacaaacgcattggtgccgataagcggattaccttgtatgttgataaggatatcaacaagattgtaacttctggtaacatctgggatctgtatacagcgattacaccaactggtggcacgccggaagctaaagacggggacacgagcgaacagaagccaattacgttagctggctatcaatggactgatcctgatggtcggtttgtattgacctcagatggcatcttgcttgatccggtagccaaccagcagtggagtcggctattaagcggtggcgcaaggccagatgccgctggcgcctatatcaatcgggtcaacacttatgaagcgaccacgcaggcttcactcttgcagtcagcattgagcgacctaaagaagcacaatcacccagttgtcaactatgaaacggatatagcgcgtctgccggataatgtggatattggtgatacagtgcatttagctgacgaaaatgagcggttatatctatcggcaagattacttgaattgaagtccagttattcaatggatacgcacacggcgactttgggcgattatttgattgagacggatcaagttgccgctcagtaccgtgaactggctgagaaaatcaagaacattcccaaaacagtgcagtattggccttgggtacgttatgccgatgacgacaaaggtaccaatatgtcggcatttccagccaacaagaagtacatggcagtcgtttacagtaacaagtcatctgtaccaagtgacaatccggatgattacgctggcaagtgggcattgattaagggcgctgatggtgctgatggtgttcccggtgcaaagggtgcagatggccgtacaagctattttcacaccgcttgggcagatgatgtaagtggcaaaagtgggttcacggtatccggtggcgatggaaaaaagtatattggcacctatagcgacttcacacaggccgatagcaccaatccagctgattacaactgggcgctttttaaaggtgacaaaggtgatcaaggaccgcaaggtccacagggaccacaaggtccacaaggggttcccggaagcaaggatgtgccttatccatatgtacaattgtcggccccagcaagcccgaaaaaaggcgatacttggtggcacggcacgagttacaatgacgcaactgccttgcagtattatgacggctcaaaatgggtcgatcagagcattcagcaagcagtgttgaatatcaaaaagttgcaatcaattgagattgacagcgcagaaattaattctccaacaataaacgtgcctttcactcatgctcctattgaaggtggacacatattgtcaactggcaagctggctctgaatggcacttcatacaccattgatggcacaattgaagatactaagggtaatccaaatggtcaaagatatcatactgagttaaaccccgatggcttactgtcatatataacacaaactgacggtacaacgaagatggatgttagcagaatctcaatggggactcttgagtttacacacttagctagtggactgggaaacagtgcaacctatatctcaagcactttagacactgtaaaagtcttgcaattagcaaataataaccagatggtttggcagggggctatgatgcccgagaatggagacgttgcgacaatgtcggttccactgtctcaaacactaaccggctggctcattgcttggagttattttcaaaatggcgtgccaacgcataacaactatgccttcactctcataccaaaggctgcactggtatacaacacaactggggctaactatttgcgggtaaccctcacaatgaatgaagttggtacaacctacaaacttttgttttatgacgataggaatattgttggcaatgatgaaaacgcaacaggatatccagctaaagcggttatgactgaggtatacgcagtttaggaggttgctatggaagttgacaaagtaaaagccatttttagcactgatgaagatggctatatcactggctaccagcaggaattttgggacggcactcagtggcaaacgccgtttgatgatgagaaagccatcatgatcgctcctgaagagctgaaaaagattgccattggcgcctcaaagttggctgatgacggtactgttgtcatagataccgataaacaagcagcattagacaaagcggctaatcaagtgacaccgaccgcagaacagaagctactcgcaaatttaactcttgaagtagcacagctgaaggcggcgaaatcaagtgactaattatgatcagtgtgcactactttacagttgggggattgatttaacaccttatgtaccggtaatgatcaccccagatcaatacaaacaaatcacaggcagtaactatgtcgccagcaaaagctagcggctatttttatggaaggaagtgagaaagtgacattttttggatacacgattggtgactgggcagaggttatatcaatcataggggtgggagtaagtgcgggcagctggctgttcaaaaagattgccttagatccattacgctctgatattcaagtgctttcagagacaattaatcgtcagctaaaactgcacgaacaatcgctggcagacttgggacaacacttgaggacacacgatgatgagcttggcagtcactcggttaggattactcgattggaagaccatgtaggcattaaaggagaagataaccatgaagattaattggacagtacgagtattgagcgtcaaattctggctggccgttgtgccagcttctttgttggtggttcaaacggtagcagcagtcttcggttacaactgggactttgctagtttgggtaaagaactcactgcagtggtcaatgcagtatttgcgctgttgaccatcgttggggtagccgttgacccaaccacagagggcgtcagtgatagccagcaggcgttagcttacccggcactcattaccaccaaggcagctaagatcaaggcgctagaggaccagattaaggcgctgcaagcggataaagaggctgaccaggtaactgctgctagtgaagtggttccagagacgtcttctgcagcaccggcggagtcagctccggcatcttttgctccacagcaataaggaggaaaccatgaaactaaaaaccaaactaattaccttggtagtcgccttcttggcggctatttcttttgccttgccatcgcaggccaatgcatcaaagggtgatcagggtgtcgactggagccggtaccaaggggataacggtgtctttggatattctactgacaagttcggcatctctcaaattggtggatacagtggatacggcacgtacgagcaaaccacctacaagacacaggttgcatcgttgattgcggctggtaagcgggcacacacctatatctggtggcagaatatcgacaacaccaatttggccaagcaagtactagatcatttcttgcctgagattcaaacaccaaaagggtcgattgttgcgcttgactatgaggccggatcaaccaacacggcaaccttgctgtgggcactcgactatatccgcgatgctgggtacacgccaatgctctacggttataagagcttcttggttaaccacatcaacttgtcacagattgccagccgctatcagttatggctcgcggaatatcctgattacaatgtcactaccgtaccgaattacaattatttcccgagttttgacaatgtaggtatcttccagttcacttcaacttatcgcgctggcggccttgatggtaacgttgatctaactggcatcactgattcaggctacaacggtagcacgacaacgggtagtgggaaaacttatgttaagcctgctacgagcacaccagcgacaaaagcaggccagcaagccaacaacaccacacttagccagatcaaagctggcgataatgttaaggttaacttcggcacaacccgttgggctaatggtgtcgcaatgcctagctgggttcagggcaagacgtacactgttcagcaagtatctggatctaacgtattgcttggtggcatcatgagctggatcaatcgtagcaatgttgagctgttgacaacgaccagcgtgccgtcagtaagctatggctctacctacacggttcagtctggtgacagttggtggtcgattgcttacaaatatggcatgagcatgtatactttggcttctaacaacggtaagtcaatctacagtgtgattcacccaggcgatgtattgcgtgtctctggtggctattcagtggccgtatcaagtcacacgtactacacggttcgatatggtgacagcttctggagcattgccagcaagtatggcattagcatgtacacgttagccgctaacaacggcaaatcaatctatagcctgatttatccgggcgaaagcctgtatatcaggtaacaaaaaggccctctgctcgctaacgcgggtgaagtgcttttttacttatgcaataatataaatataagtaattggtggtgaagttgtggtgaagtgaatccgaaattgtgaaacctaagaaattgatatagagctatttttgcttttacaccggcgatttgaaaccctatgaaatcagtgctcaagcaaatcacaacaagaagaacatgttcgcactgcttggtcgtccgggttatgaggatatgactaaggaattgaacgcacgcctttaatcgcaagggtttgtgcgatttgaaataaggtaaataaagagctccagaatcatgttggaaacgtccgtggctgaattttggctgtcagtcaggagttatcaactggttctggggctttttttatgggcatgtgttcgggcagcgtttgaatttgttgctccacaagagttgaagcagcgttaaaaactaaactaatgctagtaattgcttttgactccagggttttagctcagttccatactgacgcgctaaattacgtgccttttcggggagagcattttcaacgtcattatagataatcaggtatctaattttcatttttccttatctatattgattaggattgattacgccgaatagtccatacgaataatttcaagcggcgcatctaagaaggaatcaatcccagccaaaaactgcttgaagtgggaggtttcgttatgtgccgccacggcctccgcatcctgccagtgttcgatgatctcgtatttatcgggatcagtgaggctttggaagtggtcatagctgaggttaccggcttcagcacgcgatcccgcaaccaattgactgatgaactgctggtagtcgctggcaagctctggtttgacgtgtagggtaacattaataattttcattttcttcctcctaaaggggttatggccacgagggcgtaatgtattgatagaggcgttcttagaaggtgaacttttgccgctaagatcgtcactacaactgattatactagcaaataaatgggcagcaatcgaaatggggtggggccataacttgtgatgagcttatttcagccggaatgggtcacaagattgggtaaacttgattaaggatttcacgagatcggttccggtgtgagcgcaaaaaagccgttgagcagacagttgatcaacgacttttttctctgggcagaaatatttaatttttggtgcttgttccgtcggcgtaattgatggtgtatcctggttcgacattaaaaatatagacattgaaatgaatggtgttgtcgccgatgctttgagctcgcatttgaacaccgcgtgcaacgagttcgttaccgcggaaaattggctttacctcgtaacggacgtagtggtcattactttgtttgagataataagcgatatccatttcatgagccaacatcaagggactattgagcgtttgagtaccggtcatgagattctttgggttattattttcaccggtcagttggtacccgattaaatggctacgattatataaccatccatgtgccgtttttttattgtgccagccggttgggttccaagttagtggttcgcgtttggctgaaggcatgagtgagcggtttaacaaggcattggcatcggtcacccggttgagactatctaaatcggaataagcggcccatgcgccttttgcagttgaaagatcattttttgaaaatgcgggatcgttgttattgacggttatttcttgctggccggtataatcgagattggctaaagtattggcatccgtggtacctgctgtcgtttttgaagcttctgtgcttggcttgctgttatctaatgtcgcttttagactgctaacttcttcacgtttatcagcaatagcttcatcgagactgctgatcgcagaattagtcttattattaagtttagtctgatcggccacaggatccgtggatggtgaggttgattttgaggtgccttgagtactgcaaccggttagtaagagacttactatgagcacgggggtaagatatttcattaactttgttttcattagcgtaatgcctttcgataaccagccgatgatgcctcggcttcggtatggaagtagacagcatttgcagcgttcatatggtagccggcttgaccaggaacgtgatagatcttgctacggctgttgccaacgatggttccttgcgtgccagtatataaatcaccttggtttgttggcgtttgctgctgtgccggcgcagcttgctgttgtgctgccgatttctgggcttcttctgcttgtttggctgcggctgcatttgccgctgcttgcgatgaggcagccgcttggatggatgccgcagctgctttactggcagattcagcctgagatgctgatgtggatgcagcaagagatgaggaagctgctgccgctcgcgatgaggatgctcgttcgtctgcggctgcttcgagtttcgtttgttctttggttaaggcttttaactccgcgttttttttagcttttactgccaataagacttttccgtgtgttctttcggtgttcagcagttttcgctgttttgtcgttaaccttttattaacaacgcttgattgcgaagttgaacctgtcgatgtttttgtgtcactcatcggggtgccaatgaacattaaaataataccgccaattagtagaattaggttgagtcgtttcgttgacggatgtttccgttgccgaaataagcgcacggcaccccagatagtcccacccaatccgagtaagattaaaaagtcgcccaatgtagccatttttctcctccaatattcctaggttcgaactaggaataatctcgaataagaatattcgtaatcccttatttacaaggtttattttcccagaaaaaaagcttggcggcaagcgtcaagctcgatttgaattaggacttcaccacgtcaacatcggcatatagactggcgatgatcgcaagcatatctttttcggttcgttcccagctgattgtttttagataggcttgtgctttttcgatattttgggtaatgatctcaggtttttcgcatgctgtttggagtgttttggccagatcacgttcatccaagtgacatgaaaaataagtgccatccttcaggaagtagctgccagtgccttccttaaaatcgatcagaggtaggccggcgctcatcatttcgtaagggaccaaagagaaattggtcattgaaggggcaataccaaaatctgcttcatggtaaagctgattgagttctgccggggtcagctttccgagattctgaccgttaataaagcgtttgctgcgacccgtaccaaagtaagttattttgagatcaattcccttggctcgtagcaaatggcgacagttttcaaggacaatttgaatagtgacaggcgcgcggcgaggactgctccatttggtgtaaaccgccagcttgatttgctttttatcttggtaaggcttgggatcgcgttctttaaacgggtaacgtgccacatcgaccgggaaattgataatgtcaatcggactgttagttttgcaatgtgtcgtaatcatatgtgcgcaccaaggccctagtgaaaccatgtgcagtccgaggctataagtacggcgcgccatctggtaacgatcaccgtatgggtagaaataaggttcataatcctggacaaaatacatcttataacccggcttatttttgatgacataaacggattcccataaagtagcgacccagatgtcagaacggtgcgattcgagttctcccattggcaaacaagttcctttatagcctggatagttaaattcggcgttttgaatcatctcatcttgactttgcggaacgtaacttagatagtaaacgtcataacccgcattggctaacaaggttcctaaatgcagcatggttgtttgaccaccatcaaagccgatgataccggtcgttacaaaagtgatccgattgccgcgcggtttggtttgatcggcaggccgatcgttgaagtatttaagtatctgatcatattgatgaatactaccatcaggagcgtcactaaatttagtttttgcaggtttcacagccattcctcctcaaaatttttcgaacgatgaagtgcaggcaaagactcgaaaattaggcagaaaaaagaagtctggtgtcacggctgcttgtcagcggcgatacccgattaaactaaaagacgatgcaaatgcctgacgcttattttagtttacataataaccgtaagctaaatagtgatcgttttcaagttcgccaaggttggaacggcgtattctgaatgatagagagggttttgccataatattatgaaggtttgttttgaaatattgccattggactgaaattctttttgtaactggccattgtgctcgtgaagttcgaggacctggttggccagtgaaatttcagctttcctaagcgcctgttcaaatcataatgaatgcttatctttaccgtgagatggggctgtgctagtgtgaaagtatcgatatcaatgaaagaacaggtgaagctatgttaacgattggagtcattggtttaggcacgattgctcaaaaagcatacttgccagtttacgcgcaaatgcaaaatcaagtgcactggttattgaatacacgcaatgaagacaagttagaacagctttcagcacagtatggacttgaaagtgcaggccattcgctacaagacctcgatggacagccacttgatgcggtgatgattcatacaccaaccgcaactcattatcagtatgttaagcattttttggaaaaaggtgttcatgtctttgtggataagcctttagcaaccgatatggcgcaagttaatgaattatatgatttggcagattcgaaacatgtcatgctgacggttggctttaatcgccggtttgccccaatgattcaagatttagcgcaagtgacagataaaacaggcgtccgcgttgataagaatcgcattgatgcgcttgatgataccgaacatgcactgtgggatcttttcattcatccggtagacactgcactgatgctcgctggctatccggaaaaaccaaacacccgctatgccttgcacaccacaagtgatggccaacttcaacaagcaagtgtgacgttcacggctccaggtattcgcggtgaggcagggattgacttacaagcaggcactaaccttgaagaggcacaagtggcagctccaagcggcgttcaacgcgtccaaaacctggatcaactggtcgtgtatggccgtggtggcgcttcacaaacctttgccccagattggcagcctatgcttgaaacccggggatttgcgccaatggtacaggcatttgtccaggccgtgggtaatccagatggccagaatccggtatcaccggcaaccagtcaattagcgcatgctgttgtcgccgatttggtcaatcaaattaacaactagacagggtactaacccaaaacgcttttgaagatcgataaaatgaaatctgccagcttggacatgagtgtcggacaagcagataaggaaggggacaagtgctatgtatcaaaaatcatttatggcaatggctgatgaagaagcaaaagcaaatgttaacggatccgatggcgggccattcgggtgcgtaattgtcaagaacggtcaagtcgtcagtcgtgcacataatcgggtgttggttgatcatgacccaactgcacacggcgaaattaccgcaattcgcaaagctggccaggcattgggaacacacgacttgtccggttgtgagctctatacttcggcgatgccttgcccaatgtgtttaagtgcgattatttgggcaaatatcaaacaagtctattatggcaataccgctgatgatgctgcggcaattgggtttcgcgatgctgcaatttatgactttatcaatgccggattaaagggggaaatgctgaagctgagtcagcatgatcgcaatctgaccatcggcgcgtttaaggcgtatcagtcagcacaaaaggaattgtattgataagttgacacacatttctgcagctggtggcttggtggaaaagggtgcgaagtggtcgcttactcgcaaaatatgtttgacatttttatagattcctgtagaataatttaggtacgataaagcgccactcattgcccgttggtcaaggggttaagacgccgcgttctcagcgcggaaacacgggttcgaatcccgtacgggtgagaaatagaataaatgtgatgaaacgaaatcctcggaatgcctttataacggtgtttcgggggtttttgttttggagagaaaagatttgaatacttgagattcaagttcaccgtcaaaagtaggaagtcttgtggcacaaatgctttggcgtttgataaatctaggctgattgttcgatattcatcattgatgtctgtacccctttgagtggcaaagactttgacgtttgatgaattacgttggatccattttgacaaccttgtgggatactttgccaaggtaattttgtccaatcgtgtctcaacagactattgaagaatcctcaaattaaattggctggggaacggttagcacaaaactgatgaatgcgcttctgctcgctgatgctggatgaaggtttatttttgtggcttttgggaatttaaagatgtttcttttgcgagagtgactttatggtgaatagattgattttaggcgaacggaaaaattgactcaactgcggtgattaggcattatagataggatataaagtataatcgttcagcaaagaagatcccaagtgagttctaacttgatagattgattgatttttatatggcaaacgctgctagccggaacttagctatgttacgagcgccgacgcgggtgatgaagatatttgaattttcgatggaagaagatggatttgatgagtagtaagaagttgaaggatattcaaaaggacgtaccaattcctgtaggtatcgttgatgaacgaccgattcatccagcccgaaagctctcagaagaagaatctgttcaaattatcgctgattttgagcaaatttcgcttgaaaaagtttttaagcgattatcagaaatacgaagggaaattcaaaaagatatgaaacgataataactgtgaagaccgccagtgtttcggctatttttatgcccctttccctgcttgtaggccaaaagaacaactgagaaatcgtctcatacaactttaaatgttggtggggcattcgatatggataatgattctattcatccgtatattgggaaaagattaaagaaatacggagaagtcctcttgcacggtacttcccaaagaacttgaatcggcattccggctcacatatgatctcagtaagaactatgcatccatgatcctaggcttgttagcttgtgagtagaatgagggaaggggggtgtggacttctaagttaaagtcaattcactaaatagagagtcagcactattttgggatggttttttaaagggagatgattctgaggtcgtggcactttactcacagttaatgcgattgcatattcctcaggtagtcactcttcccgatggcgttgactattatgacgaaatacacaccggacccaacgtctataaagcaattatgaagatctttcctgataatgagattttaaaagctccgtcagatgactatatgggcaacaagaaattgcgcgtcttctaatacaggaatttaaataaaatagttttatatgaaatacattcatataagataggcagcctcaagggagtgactaaaagcttggcgttgtgtgtacgcatgacatcaaggcttttaattacatagttgaccaaccagtggagtatacaaatgattaacaaagttatagatgcttctgttgctgaagcacggcacgcaaagtatactgacagtgtagttgatgttgtttatgttagcgaatgtaccctataaagggagggatagattaaaatgagaagagattttgttaaaaagtcttttgactattacatgtctcatccagcgaaagttgatctgccattacgaccacaagatattgttccgtggaagcttgatttttccgaagaagaatggcaatatttttggaaattgcttaaagaatgggacgaccaattaactgaatggcccgagacaacacttggatgaaaacacaacctagtcgccatgcgcggcaatttttatacacttaactaaagagtgaaagcacaacaatggccctgattgccgctgcgtcagagtgtatccacaaaatcatattcaatcctatctatgccgcgctgccgaagagatccgcaagagtcttcggcagtttttgcatgaattcactcatgatctgattaatgaccgattgagcttcatgataagttgacgctataccaattaattgtgccatgagccaactcaaagctcgcgcaatgccggtatcaggtagagcttttccatagtagaagaaaaagtcacccagcgtgcgttcctcagtttgtccactttgacacaaggcgagcagatcatagctcatcatgaccattgccatatgtgcgcataaaccgtcataaccacgtacttgcgtcgcatcaaagcgcagatattgtttagcgaccttgaagtagccttcgatttgccagcgtctgccgtacatctgaatgatgcgttcggggcgcaaattagtttttgtggttgctaaaaccaagaagcgacccttggcaccttttttagtcacgaaaaccagtttcatggccatctttgtaccatccatatcgtattgcacaatgggactgtacagataatgctgatgtattagccgtttactctgctttaacgtggcatagagccgcttaacatccatttctcgtccccgataacgaaagtacactttctctgtctgcttgatcatgccgatgccagtgatcccgcgcttaagcagttcatggaacatcttgggataagcaaaccagctatcaaataaagcataatgcaccttgacgcctgctttaatcgcttggtcaacgagttcaagtgccaccaagttcattttgcgatgggcttgctggcgacgtttggccgcaagtgagcgtccatcatacggcttttgcgggccaacctggttctttgtcttacttgaggccatcagcgcaaaggtgagcggcagaaaggtattgccatcactccaacctagtgtcaaagcccgaaagccggtatagtaccgttcatggtcatggtcgaatactttggaaagtaattcggtcttcttggagaactcgcgcgtaaatagtgaatcgtcaatgacgaaggcttgatcacggccagtcgcggcaaactgatggagatattgaatcagatgaaccgctaccagcaaaaccagccgctgccaattgatccgagcatcatccaagcaattacgtgctgtccgttttgaaaagtcgggatcggcttcagctcgatgcagtgagtaacgttgaaagatggaccaatttaaagaaatgcgttgttttgagctgaatatcatgggttgattgttgtatagtaaacatggacgtaaagactcccttgtatgttggttttggtcgacttaattatacgacgcggagtgctttgcgtcttttttaataccaaaaagtcccgatttctcgggactttctgcggatattcaactttcactctttagatgacgtacttacatgaaagagaacatgttcgacagtacaaaaattacggggtaaaatttggtcagggtcatatgacgcgcttttgaagaagagccgaacaggcaggccaaaaatggatgaagaaacgcagaaaaggggttgaaaacggatgacggaattcaaggactacatcattggaatattgaagaatcagcgagaagagccaaatggcaagtttggatatcaattcatgcggatcaccccttacacagtgattttgtttgcttgagacaatacagccaagcagaaaactcaaattgaaatacgttcgaaagaaaaaaagcctaatgaagtagcttgggaaaacctttatcctgagtatgagtgggttaacgtttaacaataaagacgaacaagtaataggttagccgccagtgaacggctaattttatggcattatgaattgtgaaatggcgcattttattacagatagattgttactatcgcgatatagtcagacaaagatactgcaactaatgacaatgtggtcaaaaagttaaactgagtcacaaattaacgaaccagcacgcgcttgatgatggagtggttgaggcgttcaagcgagccaacatagaatacacacaaatgtacgttgaaaagtacgttatagtaggtgtgctatgaagatgtctggagaagcttaagcagatgccaagatgaacgccgatcctgataatatcattatgagattcgtcaaaaaaatcacgcgaagggagctgagcagtcttggtcattcctccaattagtatcattaaatatgttaagttcgaaagcggtttgcccgtgctcacaattaagcatccgacagctcggcagcaagcagactttgatcaatataagcgagccgaggtagctgaagaagcttacaaagaattacagctctcgaaggtaaagagtcgcactgaaagataagtgtccaactgcctttgaggggctatttttgtgttctttttttctgattgtaggactaaaaaacaactgaggcttctctccaatgacgttaaatgagagtaaaactattcagctggataatgagccaaagaaaaatccaaccacaaactaaagatgatccagagtatttaaaatttcgcatgcctatccaagattgcctacattctcacttgacaaccgttttaacatagaaggtgtaggcgttcctttaacattttaaaggagccttttgatataaaaatggaggcgacggcatcatgcaatatcgaattcaactcgataccaaaaaccagttgtttgtggcgattgatgcgcatgaccagaatcattttggaactggccggacaattgaacaagccattcatcaattaaaagcgacaaataaagccgcgtaataaaaccccatctgctactggcgtaaattttattgctagttgcagatggggtatttttaattggaagagaaaaagatggattactgataacgtatcaggtcgcggcgggttttgagccagatagcagtgagaatggcaacaagtgctaagacgccgattgcagcgatgatgaagaggctgcgatagttgaaccaatcgataacaaggccgccaaataacggacccagtgcacgtcccactgatccccacgaattaacgaagccttgatatcgccccttaatcgcccgtggcgttaagtcattgactagagcgggaatagcaggggatgcggtggcttcacccgtggttaaggcaatcatggcgatgacgaagaaggggtaagttcgggcggtgatgaggattagaaaagaaattgccaccatcacgaggccaaacaggatttgatagataatgcggatgccgttgacgtgttcgttaaaccagtttaggaatagctgaataaccacaattaaagctgcgttgagcgtccacaagaagctatagttgcgtagtggaatgcctagtcctgtcatataaactgacaagttagatgaccattgctggtacatgagccaaaagaccagtaaggcaaaaaagaaagttgttaacattaggtgatttgctgccggtaatgtggcttttggggatgctgccgtcgcttcttttgaaggtgtacgtgcgattttggatgctggctgaaattttgcacgacaataaaaaatagcacatacaagatgacggcaattaaaaatagcagggtgatgctgatgtcatagataaaaccaactaaagaggtgccgacaacaacaccgacgttttgcgcgaaatagagcatggtgaagacgtatcgaccatcttttgaacgtagactggtgccgagagaattaaccatggtaatgttccaaccggagccgataccaagtagtgccagccaaaaacagtaagccggccatccatgccaaattgtcaggccaattaaaacgatgccggtgaggccgacgccaaataacgttagccgaaaaggatcgctttggtcatacagccggccgccgacaatactgccgataacgctgccaagtgagttgagtaataaaacgacaccgataaccgttagagagatatgaagccgattatgtaaataaatactggttagtggccagataaaactcatgccgatactactcagtaaagcaccagttagaagccagcgcagtctgatttcgcgttgcatgacaacaccatcctttgtatgtcaacatatttgggggatcgggttttgaagcaccgaaccaagacttgaatcgtgatcatggtgttctagctgtgtcaaactagttaagtcagcgctgggtatgaatcaacccatctgcttgtcactaataaatgttccgtcccaatataataaggccatcgtacgtcaagcatgagtagtaggtcaaacctatttttatagccgtgaccgctgactttttcgggtgggcacggatcggagcgatcaaaacctgcctgcattaaagccagcatgctgaatttgtttacgttgaaaagcttatgacgttgctggcacccacatgcgcagataagtgatgaagtgaaggacaatgtcaagtaacagtaaaaccccagcaaaaaagcggccctcattttgaccgcttgcttgctattaaaggttcttatccatgttgaaggttagttttgaaagtttcaagctttccatgacgtattcgttgatcaaggctttcgttgccgctttggtatgcgcgacaatcttgtaattggcgtctgtcagatattgcgttaattctttggcgccaagttctttggctcctttgtcaaagccttggatcatttcgcgatagtcgcggttcaaggcggttagatagtcacgatccgcttgaatgaactgggtgtaatgtgcctctaccaatacatcaagcaatcgatgcagccagtaagccgaatcagcatcgatatcaaaggttttcggtgttttggaatagctcgggtcggtgtcattcgcgttgcaataaaacgggacatacgggctaaatgaaggcatgccgattgccagccacataatggcttccaaaccttcctgaacatcactgcgcaactgcaggatgtgggaattctgggttcggtttaaaccaatcggccgataacggaagcggtcggcatcatcaccgtggccataaggatcaaaaggtgtttcgttatagtggctgccaagaatctgggcaatatcttcgcgggtgatgagatgatcggtccgcatgataaaaggcaattccgcagattccggatcggcttcaatttcgggattgagcagtttatgaccgtaccaaacgcgtggggtgttgtaatgacggtctttttcattcatcgtgccgaaaatgtggcggaaattccagccttctttgtcggtgttgaggtgatgggtttcgacaaattcctgaataccttcgctccaagcaaaattgtcggtgtcgtcaaaatcgacttgttgaatcgcaacctgattggccgcaatcgcataagcatcatcagggatacgttgggcaacccagtgatggccggtgacgatttccatataccaaacgctatctttgtcggaaaagagcaccgagttaccggctggcgaaccatattgtttgatgagctggccaaggtattcaacgccatgacgagccgattcaatgaaaggcagtaccatattaacaatcaagtcttcatccagaccgtctttgacaagcggatcaaaacccaatgcccgttcattgccataagtgctttccgttgccgacattgcaacgttacgttcattaatgccgctttcttcgtagtcgccaagtttatcgttttcaacgtttggaacagcgttgtagcgataaccattttcaggcaaatccgcctcgaagccattcagcggtgacttgacgtgcaaggatttctcgcctttccatccggcgtgcatatagaaccgttgcggcgtcaggggactaaacgtgtcatcgttacgagcgatcatcgttgaaccgtcaatactggcctttttaccaaccagaatcgaagtacatgcagattcaattttcattcttgcgcctcacttcttaagtattggtaatagtttacgccagaattaacttttttgcaccttcatcaaaaaagtcgttgacaagtgcgcgatttttttttaagatattactcgttgttaagttactgggtagtagcgaagtggtaacgcagtggactctgaatccataatcataggttcgatccctatctacccaagcagttcacagtgaccgcgattcacaagcgcttatgaagccttgtgggtcgcggtttttagttgtttttcagagctactggtgtttttaaaaaagcatcaaaatatcaccatatagcaccacaaagaataggcaaacctataatatagctggtctgccttttttatttttatgatcccaaaagtttcacacacgctgcacccaagccaaaaacccagcataagcaaagcacccgcacgtatagatcaagaaagcagcgataatgaacgccaaccacggccaggttaaaaaggcgcgggcgatgaataagaagaaagccatcaataccgcacgtaatccgcgggttaagacggctttgacagtgctattcaaaagaaacctcaatgagtaactgcttggccttggtcaaatggctggtcgtgagccacatctgatcagaggaaggggcttcaacatcttcacctaaatcaggcaacaagcttagcaaccaagcactaatgtcaggattgtcaaaagaaaagtgctctggtagtcgaataacccgcagccgattcggtggaaagaaaatttgttgttgcgggaaaataacttggtcgtcaagtaaaatactagcaacattttgatacggtacctgacgaacctgataactttgcggatggtcatgcgcatatgccagaatcataatggctgcgtcaatcacaaaaagacctccattcaaatcaaaattatttacgaaattcatgataacataatagagagcgtgagcgggcccggttagaagtcggagtgtaagtggcctcagccgtgatggccggtctttgaccattgcgacaaaggtccttacacgtagattcctgcgccggggaacgcgtttaggaaaagagcggtaaccgccgcgtccaaggctcttacacgcgtcccagtgaccaagttataagtttacgctaagttgataagtccaccagcacagatatataggagcggttaaaagcatgacaaaacgattgtatttagtcagacatggtgagacgccgatgaatgttgctcgtcagctgcaggggattaccgacgcaaacttgacagcaaaagggcgtgatgctgcagatcggttgggtgaattgttgcggccgataccatttgtcaaggctttttcaagcgatcgcgaacgggcgattgaaacggctaggcgaattattgcgggtcatcaaccgcaaccggcgttaatcaagttatcggctttacgtgaatattattttggcggactggaaggcgatcctggcaatgctgtgatgacgcggacaattcgccgctatggcttgacggcatcatggcgcgcgtgggtgggttcacagcgttttgccgggttgatccgatccattcgcaatgccgatccgacccatcaggctgaagacttgccggatctgctagcgcgagttcgccaagcgtttgcgcagattgatgctcaaagtcctgataacagagacattttggtggtgtcgcatggcttattattgagtgccttaatctatcagttggcaccggaacagttaccgctggggttgttaaaaaataccagcgtgacacgagtagatgtgactgacaaggggatgcgcctgcgtggagtcaatttgattcgcgaatcagacatcttggcgttgcgccatgatgagcctcaaaaggacgatcatcagaatgaacctcaaagtattgaccaaggtaaagagtaatcaatgttagaagaacttcgttagttagagaagctattgaaaccaacctcaaaaacagttgcaagcggtaaattcagaccattgactgaatttgccgtttttgagttagtgtagaatttctatcggtaaggcgataggtccaaataatagagccatgaggaggagtttaaaaagaggcccgcttcgctaattaagttaccaacaagagtagaggagcaagtgaccttcatggaacaagtactatcaggaatcatgccaaagttaacgggaaaatcatctctatagatccaagaaaaagttgatacttctattttttgattgcattttgtggcatgggcgtctataatgacaccttgtcatatgacgggatgtcataatgaaacactttccaaattgacgaatagatgaagactaggaaggaggtcgccatgccgaaagcaactttttttcgattgccaaaagctaagcaacagcgattaatggatgcggcttatcaagagtttgcgcgggcaccatttaatgaagctagcattagtaatattattaagcaagccggtattccgcgtggcagctattatcagtatttcgatgataaggcggatctttatttttatttgctggaaaatgtccgacagcggacggtggcattcttacaacaagtgatgaccaaacatcatggcgatttgtttgcggcgatgtcagaattttttgacaaagtgatcacagcgctcactcatggcccacatgctgcattgtatcggaatgtttttttgcacatggatattcggagtgccaccaaaatggcaaagtcggatgtgccattttccaagccaccgcacgggcatggtgaaattcatgcgtttttgttaaccagcattgatcgcagtcgcctccggattcaaacggatgatgagattagtttgctgattcgccagattgtcggcatgttcatgcagacaatcggttattactattcgcaccaggctgaaggtaagccgattacggtcgccgaattaaaacggcgtagtcatcagctccttgactggttgcaatttggtgttgccagtgatcgtcagcagcgttagcaacgcatcacactggactatacgcggggtccaaagcaactgttaggaggaaattatgcttaagcttgcaaaaaagcgaatgtcaggactggccgtcattggcgccatattatttatgattgttcaggtcatgagtaatctgtacttgccgaatttaacggccgatattgttaataacggggttgccaaaggtgatattgactatatttgggcaaccgggatgaaaatgattctttttgccttgctcagtattctggcgagcgtaggaaatgtctttcttgcatcgcgcacatcacaaaagttaggtcaaaaattacggtcagatgtttatcgtaaagtcatcaactattcgcatgacgaaatggataaagtcgggaccagttcgctgattacccgaacgaccaacgatgtcacgcagattcaaaatgtttggatgatgattttgcggatgatgatcatggcaccgattatgttgatcggcgcaagttttctggcgtatcaaaagagtcatacattgacgatggtgtttttgattagcttgccattattggccctttttctagtcatcattatgtattttgctgtcccgctgtttaaggcgatgcaaaaaaagactgataatattaatctggttttccgtgaaggcttaaccggtgtgcgggtcattcgggcgtttcggcaagatgattttgaacagaatcggttcgaaggagtcaatcaggattacacccaaaatgcggtcaaggtcttctcaattattgccgctgttttcccggtcatgaccttgattatgagtggtaccaatatcggtatcacttggtggggcggccatttaattgctcaacaggcgcttgaaaccgggaacttgatcgcgtttatgacttacgcgatgcagattctgatgagtttcatgatgctttccatgatcttcgtgttcattccgcgtgctcaggcatcagcggcacgtttgaatgatgttctggcacaacaaagtcggatcaccacaccagaagcgcctaaagcattagataccgctcatccggcattggcatttgaccatgttcagttccgttatcaccatgccgaagaaccggccttgcgtgacattgatgttcaggtaaaaggcggacagaccttagccatcattggtggtaccgggagtggtaaaacgacgatggtcaacctcattccgcgcttttatgacgtggaaaaaggggccgtacgcgtcgatggtgaagacgttaaagcagttgatttaaaaaaactgcatgaagctgttgcgtttgtaccgcaaaaagcgaacctcttcaccggaagtgttcgcgataacatgaaatatgggaatgaaaacgcgactgatgatgacatctggcatgccctagaaattgcccaggcccgcgattttattgaagctaacccagaaggtcttgattatcaggttgaacaaggcggcggcaatttctctggtggacaacggcagcgactagccatcgctcgcgcattggtaaaggacgcctcgatttatgtctttgatgactcgttttcggcgttggatttcaaaaccgatgcgaatctgcgtgcagctttgaaagccgatgccaagattcagaccaaggtggttgtgattgttggtcagcgggtttcgacagttgcagatgctgatacgattgtcgtgctagacgaaggtaagatggttggtaaaggtacgcatgccgagttgaaagccaacaatccaacgtatcaggagattatcaagtcacagattcgggaaggagacgagcaataatggcagacaatcacaaagcccaaacgaccaagcagccatctggcccacggatgggtcctggccgtggtggtctcgttgaaaaaccgaagaacttctggggcacaacagcgcggttatttggttacatgcgcaaccgtctgattggtattattgcggtgctagtcttggccattgcttcgaccgtctttcaaattcgcacaccaaaaatcttgggggaagctacaaccgagatttttaaaggggttatgaaaggccaagcggagcaaaaggccggtatcgctgttggcaactatccaattgattttgataagatcaaacagattattttaatcgtcttggttctgtatttgggtagtgcactgtttagtttcttgcagcagttcatcatgactcggatctcgcagaatacggtttaccagttgcgtaaagatctcaagcacaagatgaagactgtgccgatcaagtattatgacacgcatagtaatggcgatattatgtcacgggcgattaacgatatggataacatcgcctcgacactgcaacaaagtctgacgcagatggtgaccagtgcagttatgttcgtgggaaccatttggatgatgcttacgatttcctggaagttaacgctgattgcgctggtaacgattccgctgggcttaattgttgtcgggattgtcgcgccaaaatcgcaacggttctttgccgcccagcaaaaagctttaggtctcttgaataatcaagttgaagaaacttatggcggtcaggtgattattaagagttttaaccgcgaagatgatgaagtagaggcgtttgaaggccagaatcaggcattttatgatgcagcgtggaaagcacagtttgtttccgggatcatcatgccgcttatgattttcctaaacaacattggttacgtgtttgttgcgattatgggtggcattgaagtttctaatggcacgatcacccttgggaatgttcaggccttccttcaatatatgcagcaattttcccagccgatttcccagcttgctaacttggccaatacgattcaatccactattgccagtgccgagcggatctttgcggtgttggatgaagaagacatgcaggatgagccgtctggtgtgccggcagtggccaatgatcctaacaaactggtcatggatcatgttcagtttggttataccccggatgccttgttgctcaaggactataacctgcaagtcaaaccaggtgagatggtcgcgattgtcgggccgaccggtgcggggaaaacaacgatcatcaacctgctagagcgtttttatgatattagcggcggatcgattcgcttgaatggtaccgatacccgcgatatgaagcgagaggatgttcgcgcgcattttgcgatggtgcttcaggatacttggctgtttaccggcacgatttgggataacttgaaatatggccgcgaagacgcaactgacgacgaagtattggccgcggccaaagcagcccatgtcgacaactttgtgcggcagttaccggatggctacaacacgattctgaacgaagaagcctcaaacatttcgcaaggtcagcgacagttgttgacgatcgctcgagccttcgtggcagatccggaaattcttattctggacgaggctaccagctcggtcgatacgcggacggaaattcatattcagcacgctatgaaccgtttgctgactgatcgtacgagcttcgtggtcgcccaccggctgtcgacgattcgggatgccgacaagattatcgtgatgaatcacggctcaattgttgaaaccgggaatcatgacgaactaatggctaaaaacggcttttatgctgatttgtacaacagtcagttcagtggcaatgtcgcgatttaagttagtttgcaatgatgctgagacctagacaaatattgcgttgcagggaaaatgtttttattctgtgacatgaaaaagggtcctgaagacaagaacgatcttgtcttcgggacccttttagcgttaccgccgcttgtgccgcataaacgttgcgtagtgtagcaaacaagcaagtaagacgaaaaagatgacaacaaagctgacatagcgccaccagaagttggttgccacacctggtatgagttgctggatacccatggttgccaaagccattaccgcgatcatgccgaacaacaataagtaacgtttcaaagtctcatcatccttctttttaaaagtggccaattttgccccgagcgcttgtgcttgtttgaccttggccgctggtaaagccgtcatgccccaagtatgcgggagaaccagttcagtaattttatgtaaaccggcagcggtcatggctttgtcgatggtgacaagggtcgcatcggtctggtgcgtaaacgtgttgtccagaccggtggcaaaacaactggtgacgctaacgtaatgtttatctttaaactttcccggaagcgtatccccttgatgcgtcatccgagtgatgcgatggcgtaaacaatcgagtaactgcttaaactgtccagccacggttccaaagtaggtgggtgttccaagaatccacacatcagccgcgtgcaacttttcctcgagttcgtctagcacggggttggtctgaccggggcgatcaggtcgcagttggtactgatttaagtcaataaactcggttgttgccggcgccgtaacaccggcaagaattgttttaactaggctagccgtcaacccatcaggatcctgcccgccgtaaatacctaaaattttcatttgaaagcctcacaaatcaaaataaacgacttaagtaacaacctgccaaaaataacaatttttgcaagtattacttcctcttaactttaaaaaagattaagaatttttgcaaaccgatccttgtactcatgcgcatcaagctttttattggcaaaaaagatgaagactcattatgctgttggcagcaacaaaaggttaaaggcgttaggatctcatggatgaatgagaaggagagggtcaacatggcaggaattccattgccggaagaaacacgcgtggattttattgcgcttaaagtggctgacttggccaaggtgagtcgctggtatcaagacgttgcgcggttggatttattgcggcaaaacggcagtacggtttatctgggtacgcggttaaatcagcaggtgttagtcgtgttgcatgagattagcggattaacccctcaagaagcggtcaccggactggattattttgccattttattaccgaatccgggggctttaggggcggcgtatcgcattgttaagcaggatcaggcagtgaccaaggcatttcagacaaattatcggcaaggctttttggcgcatgatccggaaggtaatggcgtggcctttacaattgatcgtgcaattgaacagtatcaagaggagcgtcaatacaattgggatgatgaagtggaacaggcgcttgatcccgaagaaattggcaagcatgcggtgcgcgattatgaccgcctgccatcagggacggcgatcggctacgttcagtttcgagtggctgatttacaaacgaccagtcattatttggagcaaggacttgggtttcgcgaaaaggcaacacaggtaaaagatgagatctttcttgctgcaggcgactatcgccatcacattgggattaatttacgccgggatcccaaattatttttacctacgcctgatatgtatggattggactatgtgagctttattttgcctgacaaaatgacgatggccaatattttgatgaaccttgatgcggctggcttaacggattacgattatcaccatgagaaccagtttttgatgatcgctgggccgaatcgactgacgctatggtttcgagtggcgtaaccgatctggccttggatcggaaagaaggccaggatggattttcaagcagtaacgacagggttgcaaaaatgggtagcggagcagattgtgccgggttttagtgttgcattgttaaccggtaagcgggttcaaaccaaggtggcaggtgaagcgcagtggctgccgcatccggaaccgctgcggcctaagatgctttatgatattgcttcattaactaaggttgtcggcactaccactgtctttttgcaggcgtgggatcatgggctggttgcgccaacgatgccgttaaaacagctgttgccggcgtttccacatgcgaccacgtttcagcaggcactgacgcatacatcgggacttgaggggtacattcctcatcgcgatgctttgcctgccccggctttaaaacatgcgctgctgactcaattagcggtgacaaatgaagtgaatcgcaaggtggtttaccgagatgtgaatttgctgctggttggttgggcacttgagaaagtgtatcaccaaccgattcaaaaactagtgacacggcaggttttgcggccactggatttgccacgagccacttttcaacctgaaacagcccaatgtgtgccgactacttatcagccactttcgggattacgacgcggggttgtgcatgatcccaagagtgccattttaggagcgcatagtggggcagccggcttatttgccagtttggatgatctgatcatatttacccagtatttattcggacttcgaaccgctgaagcttggccaaaacatgcccaagacctaacgcgtgactggaccgttcatcatcttgggcgcagtctcggatgggatctcagacatgacaatcagggccgcttatggctttatcacactggctataccggaactttttggttggttcaaccgcaaagtcaactggcactgattgtcttgacgaatcgcgtccatccgcagcccaatcaggaatttctgggaagacgcgatcagttggttcaccggtttttgaatgatcagccgatattagaccagtaatgcgtacacaaaaacagggccgacattcacgaccctgtttttgtgtgtatgttagctttaaccgcttaaaaaccgcctttaatatagccaccatcactgagttttttccgtagttgcagcatcgccgtgtacgttgcgaggacatagagttgttgctgcggcatttcctgaagcgtcgtgagcacgtcgccgagatctggcttaatggtaagcttggtttctggcactcccgctactttcagccttagggcaatatcttgatagcgctcgccgccaaccaggtagtcggcggcttttttgctcgcaacgaattcttcaaagttgccgtcccaaatccagctcgtatcaataccatccgcgtaattggcgttcagtagcatcgcaaacccaaaaggctgcttggcggtttgaatcatgctcaaaacctgattcaggccaacgggatttttaactaaaatcaatgttagctttttggccccgagttgaatgacttcttggcgtccgaagactttttcatcgtaggcaaacgcttggctgatttgttcagggctgacatcaaacgttcggccaactgcaaatgcggcaagggcattgtagatgttgtacatgccgccaatgtcaatgtgacacggctgaccgtcaatgacaaactcactgctttgcggcgtcattttggtaacggcattaacttgataggtcaactcaggtcgtttgaaaccgcaattaggacagaagaagttacctagattagcgtaagtcaaagcgtgataatgcaaaatgtgctggcaaaccgggcaaagaacgccatccgtattcggcggggccttgtgatcgccttcgttggtcaacgtaaagccgtaataataaatcggattgggcaacttccgcgaactgaaaatcggcgcatccccattagcaagcacgacagcggtgggatcaagcgtgataccatcaagaatcttttggtaagttgtgtaaaactcaccatagcggtccatttggtcacggaaaatattggtcagcacaaacgctttaggcttcaactgcgcggcaacgggagcgacattggcttcgtcgacttccaaaacagcgatcccgcgaccatgaccgcttttgggctgggctaaaaaagcggtcgtaatcccttgtaacatgttggagccggtgggattggttaggacttcctgatatttttgtttgagtaccttgacgatcaagctagttgtgagcgttttaccattcgtaccggtgaccacgatcacatcatagttatggcctaatgcttgcagaacatggggatcgaggcggttagcgatttttccggggagactcgatccacctttgaaaaatgtgtgtaagaaccagtagctgctgcgaccaatggcagttgccaggctggcttttgctgaaaatgccacggcgttcttcctctcaacttaatgggactattttagcataacttgaaatcaaaccggcagccggagtgttctttgcgaaaaaaatccgttatactgtgagacgtgagattttaaatggaggcggcatatggcccagcttttctttcgttatggcgcaatgaactcaggaaaaagtattgaaattctgaaagttgcccacaattatgaagaacaaaataagcgcgtgattttaatgaccagcgccgtggatgatcgcgccggtgttggcatgatcgccagtcgcattggtcttgagcggactgcgattccgattgcgcatgaaacgaatctgtatgatgtcattaaaacgactgatccgaaagcggcatgtgttttaattgatgaggcgcagtttttgcagaagcatcatatttttgaagctgcgcgggtggttgacgagttgcatattccagtcatggcgtttggcttgaagaacgatttccgcaatgagctgtttgaaggttcaaaatatttgttgctgtatgcggataagattgaagaaatgaagacgatttgctggttttgcgcgaaaaaggcgattatgaatttacggattcatgatggtaaaccggtgtacgaaggcgagcaggttttgattggtggcaatgaatcgtattatccggtttgccggcatcattattttcacccgccgttagatcggattgatcaggatgaggaatagatgtttggtcggtgtggtttggctggttcgcgctctgtcataacgcgctcaccggcgcagaagtctgcgtgcaaggacctcagccgcaatggccaaagcccggccatcacgtctgaggccacttacactccgacttctaaccgcgccggttcgcgctctatcataacgcgttcgccagcccagaaacctgcgtgtaaggaccttagccgcaatggccaaagcccggccatcacggctaaggccacttacactccggtttctaaccgggctggctcacgctcaggaggattttatggataagatttttgaacagttggacgggcttttggttcgttatgaggaactagaagagttgatgtcggatcctgaggttatcagtgatacgaaacgttacttggctttgtccaaagaagaaggcggcatgcgagatgttgtggctgcctataagaaatataaacaggtgctttctgatattaaagaaagcgaagaagtgcttcgtgagagtaaagacgaagacatggaagcgctggctaaggaagatctggaggacttgcagaagcaaaaggccgatcttgaagagaagattaaggtgctgatgctgcctaaggacccgaatgacgataagaacattattatggaaattcgcggggctgccggtggtgacgaagcgagtctttttgctggcgacttgttgaatatgtacatgcactatgcggaacggcaaggctggaaggcggagattgttgattcaacccctactgaagtcggcggttataaagaagtcgtcgtgatgattaccggtgacaacgtatactccaagcttaagtacgaaaacggtgcccaccgcgtgcaacgggttccagtaaccgaaagtgccggccgggtgcataccagtaccgcaactgttggtgtcatgccggaatatgacgaggttgatttgaagattgaccctaaagatattcggacggatgtttaccgttcttccggtgccggtggtcagcatgtcaacaagaccagttcagcggtccggatgacccatattccaaccgggattgttgtttccatgcaagacgagcgtagtcagcaggaaaatcgtgcccgggccatgcaaattttacggtcacgggtttatgactattacgaaaccgaaaatcaggaaaaatacgatcaaaatcgtaagaatgcgattgggaccggtgatcgttccgaacgcattcgaacctataattacccacaaaatcgggtaaccgatcaccgtattggcttgacgcttaataagctggaccgcattatgaatggcgaactggatgaaattattgatgcgctgattgtccacgatcaggcgcagaagatggaatcgctcaatgtctaaaacatatgctgaggcgctcaagtgggcgtctttgttattgaccaagcaaaaagttgatcccgacggcgctcggtacgtcctcatgacacgcgctgactggacgccgagccaattgattttgcatcgccaagatccgatgccggatgctgcctggcgtcaatttcaggcggatgttgcgcgattggccaactttgagccggcacaatacattaccggtcaagcgcctttttttggcacgatgtttgctgtgaccccagcggttttaattccccgatttgaaaccgaagaacttgttgcatgggttgcagaggagcaaacgaatgcacaaaccggcctcgatatggggacaggcagtggggcgattgggttaaccctcgcccgtcagttgccacaaattgacatgacgttgagcgaggtttccccgtccgctttggctgtcgcgaagcacaatgccgcggcacagaaagtgaacgtgcattttgtgaccagtgatttattcaaccacctgcctggacgctttgattttgtggtgaccaatctgccttacattgcgcctgaagaaacctcggtgatggatcaaagtacgttacggtatgaacccaagttggcgctgtttgctgatcatcatggcttggcattatttgaacggtttgtcactgaactgccgcaacatctaaacccgcatggcgcagcgtatttggagtttggctatcatcaggaaccggcactgcgacaattatttgctgaaaagctgccgcaagctcaagcaacttttcgccgcgacatggctgggcatccgcgcatggtcaaacttcaattttaggttgccattgtcagaagaagacacgtcatctttcagctcaagtccgatgatgtggtattttagtaaaaacgaacagtcaatggatatggaggcatcattttggcaaaacgttatcatgaatcagatattccggaagcagcagccgctttaaaacgtggtgagttggtcgcttttccaactgaaacggtttatgggttgggagcggatgcgactaatgttacggcggttagtcaagtttatgctgctaaggggcgcccatcggataatccattgattgtgacggtagccgatgcggcaatggttagtcagtatgccacgattaccccggatgcggcgaaactcatggacaccttttggccggggccgctgacgattattttgaatattttgccagggcgtttgtcaatgaaggtgacaggcgggttgcaaaccgcggcatttcgcaatccggatgacgcgttaacccgaaagttgatcgcaaccgctggcgtgccgattgtgggaccgtctgccaatacatcgggcaagccaagtccgacaacggccgatcacgtgttgcacgatctagccgataaaattgccggcgtccttgatgatgggccaacccgagtcggagttgaatcaaccattattgatttaaccgtgaccccaccagctattttgcgaccgggtgcaattggaccgcatgaattggaaccgttgcttggaccagtcgactcggcggcgcatcacgtaggcaaaaacgaagcaccgaaagcgccggggatgaaatacaaacattacgcaccagcagcgcaagtcgttgtagtggatacgattgatcaatttgatgatgcagtggcgtgggctaaaaagacgggccaaacttttggacttttggcaacggatccgattcttgcccattttcccgatgtgcctagttactcgttgggtcaagatattaccagtgctacacatgccttatttgccgggttgcgctggtttgacttacatccggacgtgacactcgtgctggctcaagcctttagctacagcgaattaagtgccgcttatatgaatcgactgcttaaatcggctgggaacatgcactatcaaccgaatatgccaacggatcggttttgatttgctataatatagccaactgacagcaacaagtcggttggctatttttgtgagcgtgaaccggcgcggttagggatcggagtgtaagcggcctcaggcgtgatggccgggttttggccattgcgcctgaggtccttacacgcagatccctgcgccggtgaacgcgttatgattaagcgcaacgtgttggggaaatctagtcaacgtgctttggcatttgctagtttgcacgggttaaacggcgatcatctatcgataggtggatgaatcgattttaaaaggagagtggtaggcatggatttaatggcgcatgatccagaagttttccgcgcaattcacgaagaagaagcgcgtcaggaacataatatcgaattaattgcttcggaaaatattgtttctccggcagtgcgggcggcacaagggtcggtgttgacgaataagtattctgaaggctatcccggtcatcgttattacggtggcaatcaatacatagacgtggttgaaaatcttgctattgagcgggcgaagaagctttttggtgctgaatttgccaatgttcagccgcattctggttcgcaggcaaacatggcggcatatcgggcgtttcttgaagacggcgataaggttttggccatggacttgacggatggcgggcatctcacccatggcagtccagtcagttttagtggtcaggaatatcatttctaccattatggtttggacccgaaaacagagcgcctcgactatgccaaaattcgcgagcaggcagaacaagtcaagccgcgtttgattgtggctggtgcgtccgcttacagtcgggaaattgattttaaaaaattccgcgaaattgctgatcatgtcggtgcctttttaatggttgatatggcgcacattgcgggcttggttgcggcgggattgcacatgaatccggtgccgtattcagatgtggtcacgaccacaacgcataagaccttgcggggaccgcgtgggggcatgattttggctaaggcggagtatggcaaagcaattaattcagccttgttccccggcattcaaggcggaccactggatcatgtagtggcagctaaggcggtggcattaggcgaagcgttgcagccggcgtttaagacttacgcgcagcagattattgacaacatgcatgcgatggtggcaggtttcaaggaggatgaacacttacgcttgatttccggcgggtctgacaatcacatggtcttagtcgatgtcaccggttacggggtcaatggacgccaggttcaggacttgctggatgaagtcgatatcaccacgaacaagaatcaaattcccggcgagcaaaatggtccgtttaaaaccagcggcattcgggtcgggacagctgcgattacgacgcgtggatttacgccagaagaaagcaaacgcgtggcagaactcatcagcatggccattgcgcatcgcgacgaacaaccggttttggatcaaattcggcaagaagttcttgcactgactgcccgtcatcccttatcatagatagggtttgcaaacaaatggttctcacaggaggcgcttcatgggtaaatttacagttttaaatcacccgttgattcagcacaagcttacgttaattcgcgacaagcatgctggcaccaaggaatttcgcgaaatcgctaatgaaatcgcggaattaatggtgtatgaaattacgcgggatctaccgcttgaaagtatcgaaatcgaaacgccgatgggcaaaacggttcaaaaacagcttgctggcaagaagcttgctgtgattccgattcttcgggccgggctagggatggttgatggcgtcttgcggctaattcctgctgcaaaagtcggccatatcggtatgtatcgtgacgaaaagacgctaaagccgcacgagtattttgttaagatgccgccggatattgaccagcgtgatctgatcattgttgatccgatgctggcaaccgggggctcggctaacatggccattgaagcgctcaaaaagcgtggcgctacttctatgcggttggtagtgctggtggcggcaccagaaggcgttaaagcagttcaggcggctaacccggatgttgatatttatgccgctgcacttgatgatcatttaaatgagaacggttatattgttcctggtctcggtgacgccggcgacagactttttgggacaaaataacatgatttggcatgtggccgtgcacatgcctttttcatttttagttaaaataatttttatggtgcgtcaaggcagggagaatctgttgtctgatgtgaaaacatgagtgaaaaagcctctatggcggcaaaagtttctgcttttctggctttgtcttttcatcgaaatggtgttagagtaatgattgtgtttcaagggtataccctagtatcaacgattatcgaagtctccgtaatcttgcatcatcggtttgatgatacatacgatatgacgccgcttcagtaaggaggtgaattctgtgaacgaacaatatccctcgatcaagcttttcggcttaaatttcaacctgaccaatgacattggcgtattggtttcggcgatcttggtattcttactggtgttttggctgtcacgcaatttgcagatgcggcctggcgcaaagcaaaacatcttggaatggattatgaattttacgaacggcattgtgaagggtgcaattcccggttcacaacggtacacttttaacctgtttgcatttacgctgttcttgttcattttcattagtaatcagattgggttgttccttgagcttgatattggcaaagacacctggtttcgttcgccaacagcatcgcctgtcattaccatgacattggccatgacagtattggttatttcacattattttgggattgtttttaagggtttcaagggatatctcaagggatatgtgtcaccgatcggaatcctgcttccaatcaacctattggaagagtttacgaactttattacactttccttacggttgtatgggaatattttcgccggtgaagttttagttttactcattaggcagcttgctttttcgggcggagcgtttagttttgtttcaggggtcttgcttgagatcgtttggcaaggcttctcagtcttcattggtagtattcaagcgtacgttttcgtcacgcttggtatggtttatacgtcacacaaagttgtgtccgagtaattaatttaggaggaaatttcatatgcaattcatcgctgcatcaatcgccgctggcatcgctgctctcggtgcttcaatcggtaatgggatggttatcagcaagacacttgaaggtatggcgcgtcagccagaaatggccgggaccttgcgtggtacgatgttcatcggtgttggcttgatcgaagctgttccgattatttctgttgttattgccttcatgttgatgcttcgttaattttgagtcatcaataaagaagggagtggcaaaagatgagtttaggtgacacactcttcacgctcgtcacatttttggtcctgatgatcgcggtcgggaaagttgcttggaagcccgtctcaaagatgatggcggagcgccaacaaaaaatttccggcgacttggattatgctgaaaagtcccgcaaagatgccgaggcattagcggctaagcgtcgagaagcgctgcaacacgcccaagccgatgctgttaagattgtcaatcaagctaaggaaaatggtgaaaaacaacgccaatcattggttgacgctgctaacaccgaagtcgctacgttaaagaaaaatgcgcaagcggacattgaccaagcgcgcaaagacgcactggccagtgccaaaaatgatgtggcagatttaagtttaaccattgcccagaagctgattggcaaggagcttaatgcagacgatcaaaaagacttgatcgacgactatatcaaacggttaggtgatgcaaatggcagtcactaatcaaatggttgcaccgcgttatgctaaagcgttgttagaagcggcgcatgaccaaaatcaggtggagacggttcatgaagagttacaggcgttagcgtctgtattcaaagaaaatccaacaatcctgacaatttttgacaatgcccgaatttcagccgcagacaaagccaacttgttgacaactttgaccaaggatgcaagcccacttgttgctaacttgttaaagttgacccaacagtatggccgattcggtgcattaccggcaattatcacgacgtttaatcgcgcctatgatgatgaagccggcattattgcagcaactgtgacgactgcagttgctttgtcagccgaccaagccgatgctttacgcagttctattgctgagcgttttggcatgaaattgacccagcttaagcaaatcgttgatccaagtgtgatcggcggtgttcgcattcaagctcgcggttcggttattgatggtacggtcaagcaccgctttgagaagatgaaagcggcactgctggcagattagagataagtaaagaggtgaaccggatgagcatcaagactgaggaaatcagttctctgatcaaaaaacaacttgaaggatatcaagatgatttggcggctgaagaagttggcactgtaacctacattggtgacgggattgcccgcgccacggggttggaaaatgccatggccaacgaattgctccaatttagtaatggctcatacgggatggcgttaaaccttgaaacgaatgatgtcgggatcattatcttaggtgacttcgatgagattcgcgaaggtgaccaggttaaacgaaccggtcgtattatggaagttcctgttggggaagccatgattggtcgggttgttaactccttgggtcagccagttgatggcttaggtgcgattaagacggataaaacccgcccaatcgaatttaaggcaccgggggttatgcaacgtcaatccgtgtcagaacctttgcaaaccggactaaaagcgattgatgccttggttccgatcggccgtggtcagcgtgagttgattatcggtgatcggaagaccggaaaaacatcaattgcgattgatacgattttgaatcaaaaagatcaaaatatgatctgtgtttacgttgcgattgggcaaaaggacagcacggttcgtgcccaagttgaaacgttgaagaaatatggcgcgatggattataccattgtgctaaccgctggcccatccgaacccgcaccaatgctatacattgcgccttatgccggtgcggcgatgggtgaggaattcatgtacaatggcaaacacgttttgatcgtgtatgatgacctaagcaagcaggcaacttcatatcgtgagctgtccttgctgcttcgtcgtccgcctggtcgtgaagcctatcctggggatattttctatacgcacagtcgtttactagaacgggccgcaaaactaagcgacaagcttggtggtggctccatgactgctttgcctgtgattgaaacccaggcaggcgatatttctgcttatattccgaccaacgttatttcaattacggatggtcagattttcctgcaaagtgatttgttctatgcgggcacacgtccagcgattgatgctggtgcgtctgtttctcgtgtcggcggtgatgctcaagtcaaagcgatgaagaaggttgctgggacattgcggttggatctggcatccttccgtgaacttgaagcctttacgcagtttggctctgacttggatgcagctacacaggcaaaattgaatcgtggccgtcgaacagttgaagtgttgaagcagccggtacacaagccattgccagtcgaaaagcaagtgctgattctttatgccttgacccatggcttccttgatccaattccaattgaagatattggccgtttccaagacgaaatgtttgatttctttgatagcaatgcagctgatctgctgaagcaaattcgcgataccggtaatttaccggataccgataagcttgatgcgcagattaaggcgtttgctggcggcttccaaacaagcaaacaacttgctgcagctaaaggttaaggaggtgccgcatggctgagtcattaatggatatcaagcgcaagatcgcttcgaccaagaaaaccggtcagatcacgcaagccatgcagatggtttccggcgccaaattgagccagatcgaaaagcgtgccaagaagtatcaaatttactctgacaaagtgcgccagattgtgactcatttagctgcgggtcaacttcttgaactagctactgctgcgaatgatgacactgagacagataagaatcaggtcatttccgttgctagcttgcttcagaagcgacctgtcaaaaagacgggctatcttgtgatcacaagtgatcgcggattagtcggcagttataacagcacggtattaaaagccatgatgcagatgattaaagatgaccacgaaagccctgacgattacgtcatgatggcaatcggtggtgtcggcgctgacttttttaaagcccgcggtatgaatctggcttatgaatatcgtggcgtttccgatatcccgacttttaatgaggtacgggagattgtgaaaactgctgtgaccatgtatgacaacggtgtctttgacgagctatacgtttgttataaccaccatgtcaacacattaacctctgcttttcgggcagagaaaatgttgccaattagtgatttggatgtcagtgaagttgaagataccaatgttgagtatcttgtcgaacctgatcttgatgccgtcttagatgcggtgttaccgcaatatgcggaaagcttgatctttggtgcgatcatggatgcgaaaacagcggagcacgcggcttcgacaactgctatgcgtagtgctactgataatgccaatgatctgatttcacatctgtcgactcagtataaccgagcacgacaggctgcgattacgaccgagattaccgaaattgtcggtggtgcggcagcattggaataaatattgcgtttgttggcgcagggggctgtttgtgaggagtttggttgtaatggctggagtcgagccatcaagtctagagacacttacattcaggactctaatgtgccagcttatgcccataacgcgttcactggcgcagggacctgcatgtaaggaccttggtcgcaatgaccaaagcccagtcatcacgcccaaggccgcttacattccggtccctaaccgcgccagttcacgctcataacgcgttcaccagcgcagaagtctgcgtgtaaggaccttagccgcaatggccaagaccgggccatcacgtttaaggccacttacactccgacttctaagcgcgctggttcacgctcacttttacaacaggaggacgaatatgccaaattcaactggtaaaatcgcgcaagtgatcggtcctgttgtcgacgtagccttcccaatcaatgacaatttgccagaaattaacaacgccttgacgattacccgtaaggacggctctcagcttgtgctggaagttgcgctggaactgggtgatggtgtgatgcggactatcgcgatggattcgactgatggtttgcaacgcggcatggcggttgaagatactggcggtccgatttcagtgcctgtcggtaaagacacactgggtcgcgtgttcaatgtattgggtgacccgatcgatgacggtgaggcttttggacctgatcatcggcgtgacagcatccaccgtgatgcaccaaaatttgaagatttgaataccagttctgagattctggaaactggcatcaaagtcatcgatttgctcgaaccttacctgcgaggcgggaaggttggacttttcggtggtgccggtgttggtaaaaccgttttgattcaggaactgattcataacattgctgaagagcatggcggcatctccgtcttcaccggggtcggcgaacgaacccgtgaagggaacgacctttacttcgaaatgaaggaaagcggcgttctggagaatacagcgatggtctttggtcagatgaatgagccgcctggtgcccggatgcgggttgccttgactggactgacgattgcggagtacttccgtgatgtcgaaggtcaagacgtcctgctgttcatcgacaacattttccggttcacccaggctggttctgaagtttcggccttgcttggtcggattccttcagctgttggttatcagccaacgttggctactgaaatgggtcagttgcaggaacggattacgtcgactaaaaaaggatcggttacatcgattcaggcgatttatgttcctgctgatgactataccgatccggcgccagcgacaacatttgcccatttggatgccacgactaacttggagcggcgtttgactgaacaagggatttatccggctgtggatccgctggagtcatcttcaagtgctttgaccccggaaattgtcggtgaagaacattataaagtcgcaacagaagtccaacaggttctccaacgttaccgtgagttgcaggatattatctctatcttagggatggatgaattatcagacgaggaaaaggttatcgttgcccgtgctcgtcgggttcaattcttcctgtcacagaactttaacgttgcggaacggttcactggtcagccgggttcttatgtaccggttgaagaaacggtcaaaggctttaaacaaattctggaaggcaagtacgatgactatccagaagatgcattccgttcagttggacggattgaagaagtcgttgaaaaggctaaaaagatgggctttgctcctaatgatcaggacacggatgctgacgaaaagccagctgcacaagctgcagctaactaaggaggcgacgcgttttggcagaaacgagcaatgttctgcgggttaacatcgtgacgcctgatggtttggtatatgaccatcatgcaaagatgttagtcgttcattcggtcgccggtgaattggggatcatggcgaatcatgagccgattgtcacgccccttgaaataggggaagttgacgttcagcgggttgattcaagtgatcataacgactcaattgcggtgaatggcggctttatggaagtttcagataatgttgcttctattgtcgctgattcagccgagcgtgaacgcgatattgaccttagtcgtgcgcaagctgcacgtgaccgggccaagaagcggatcgctcaggccaaggatgaaaataaccaagatgatctacggcgggcgcaagtcgcactacgacgggcaatcaaccggatcaacgttaaaaccagtcactagtcagtgattggaaggtgatcagtcgttgcggcgttagctccacgataatcaccttgatacgccaatgtggctggattgacacacaggcgcaaaagaaggtgtcttattttccaaacttaacggaaaaataggacactttttttgaatgggttggtttttttacgatcctaatcccaagctcggcatatgccataacgcgctccccggatgcagaagtcgaggtgtgagtgccttgagtgcaatggccaagcctgagccatcacgcctgaggccacttacactccgacttctaagcgcgccggctcgcgctcaccataacgtgttcgccagcccagaaacctgcacataaggaccttgggcgtaatggccaagcccgggccatcacgcccaaggccgcttatgctccggtttctaaccgggctggctcacgctcactttctataacgcgctccccggcgcagaagtctgcgtgtaaggaacttaagcgcaatggcaaagcctggccatcacgcttaaggccacttacactccgacttctaagcgcgccggctcgcactcaccataacgcgttcgccagcccagaaacctgcacataaggaccttgggcgcaatggccaagctcgggccgtcacgcccaaggccgcttctgctccggtttctaaccgggctggctcacgctcacttaggcttgcgtgattgttgaaagtgcgggaagatgttctgtgaggtgatcgcatgtttcaggaaatcggcctaaatgctgccataacccttgtttcccattttgttttcatcatggtggcatttcgggcgttgaatgcattacgctttgagcagtttattaaggccaatcatgttcgcgaggcacaggtgctgttactttttatggcagttggcttaggttatttagttagttccttctttttatcactggttcaagcagctttaaacttacctaaacttttcctataaaaacctcgtcttaactatgttataatgcgatagttagtcaatttacgaggagagatatatacccatggcaaaagatattgggatcgacttagggacggccaatgtactaatcaatgttaaaggcaaaggcatcgtcttgaatgagccgtccgttgtcgccattgatacccataccggcaaagtgctggcagttgggacagaagcctacaaaatggttgggcgcacaccgggtaacattcgatcaattcgcccattaaaagatggcgtgatcgctgatttcgacattaccgaagcaatgcttgaatatttcattaacaaattaaatgtaaaaggcgttttttcaaaaccaaatattttgatttgtgcccctactaatattacagacattgaacaaaaggctattatccaggcggcggaaaagtctggtggccgccatgtttaccttgagtttgagcctaaggtagcagcggtcggagcaggattggacattttccagccgcaaggaaacatggtgattgatatcggtggcgggaccagcgatattgccgtgctttcgctgggggagattgttaccagtcgttcactgcggttagctggcgataaaatggatgcgtccattgctgcttacgtaaagaacaagcacaagctgattattggtgaacatactgccgaacaaatcaagatcaagatcggtgcggtttatgatgccgatcctaaagaaacgattgaagttcggggtcgcgatattgcaaccggactgccacgcgaggtttcggtaacctcagctgaagtgtcagatgcgttacatgagaccatgatggcgattattgatggcgccaaaggggttttggagaagaccccgccggaactttcggctgatattattgatcgcggtatcatgctgacaggcggtggtgccttattgaaaggtatttcacagctatttgccgacgaattgaaagtaccggttctgctggctgacgatcctttagatgcagtggcactgggaacaggcgtgttattagacaatattgaacatcatcgccaatactaggagttgtcacttatggactcgcaatatcctaaacgcgtttttcatcacgtcaagatttggctgattattgcgttgattgccttgattttgggcttgttaatcggctttggtatgggtggcgataatccatttaaggtgtttttgccttcaacctggatccatttctttaacttcttacgttaggagtggacatgaaacaaatcctgacttggctggtgcggggctaccagcgatttatttccccgttatttccgccgagttgtcggtattatccgacttgttcgacgtatatgattcaggcattgcaacgacatggggcggtaaaaggatttttaatggggattgctcggattttacgatgcaacccctttgttaaaggtgggctagatccggtgccagcttattttacgttgcggcgtaatccgcatcccgaaaatgatttggatcttagtgacattcaaaatcttaatcgcaagctaggaggccatcatggctaaagaaaaaaatattaaagtcgcacagatggatgaaacccgcaatggccacacggtttctgtcttaagaatcggcgatcaggagattggttttatcgaaccggatggcacgcggtttgccgcttatgttgccggttctaacaaacccaatcgctttaaaaatattgatgatgcagtgaatgctttaattgcggaatatcatttgcatcaaggctgagcaattttcttttgttaaaataacggtaacaataacctagcgaaacactgtaggtgaatgactaacctagcttttaacggtgtggcaatgggttcatgaatgtggtgtaaggaggctggccgtggaatcgcatgaaatcaaatccaattctgaaggcgatcgcatcgactacggtattattctgtcggtcatgctgctggctttgattggactagtctcgatttatttggcgaccgctcatgatacgacaacgcttcaaaatccggttcgcgcaaccatcatgcaggctgcttggtacgtgattggcggcatcggaattttctttgtgatgcgttttgacgctgagcaactttggcggattgcgccttatctttacgggattggcattttcttgatgattgccgttttgattttttatgataaaacgacggcgattaatacaggggctaaaagctggtttgctttgggaccggttagttttcagccttcagagattatgaaacctgcgtatattttgatgctgagtcgggtcgtgacccagcacaatgccgctttttcgcacacgattcagcatgattggcagctgatcggacgcatggttttatggaccttgccgattgcgatattgatgaagttacaaaatgactttgggacaacgctggtatttttggcgatttttgccggggtcactttagttgccggcattaactggcgcattttattgcccatcgctttaattggggcagccattggaacgctggcaatcttgctggtaacccaatcgtgggggcggtctttccttggatccattggctttaagacgtatcagtttgcgcggattgactcatggttgaacccttctggcagcacaagtggcgacagttatcaattgtggcagtcgatgaaagcgatcggatccggacaattaaccgggaaaggcgcgtttcatatcgccgttgcggttccggttcgggaatcggatatgattttctcggtcatcggtgaggcgttcggatttatcggcgcggctgtgttgattctgttatactttatgttgatctatcagatgattcgggtgacatttgacaccaaaaatgagttctatgcttatatctcgacaggagtcatcatgatgatcttattccatgtgtttgaaaatatcggtatgaatattggcttgttgccactgacagggattccgttaccgttcatttcgcaagggggatcattcttattggcgaatatgttatcggttgggatggtactatccatgcgttatcatcacacgagctatatgttcagccgggacacagaagattttgaataggggagattataatggcgacaacgtatttttggcaagatgaattggctgcaggacaagttcgcttgggcttgacgcaagaagctcaggaagcgttgggcaagatcaggtttgtggacctgcctgaaattggtaccagcttaaccgtgggcaaacccttcttgagtgtggaagctgaaaaggccgtgctagatcttgaggcaccgctggctggtacggttgttgatgttcatcgtgagctcagcgataaacctgctttgttagacgaaaccgatcataacgataattgggctgtcacggtttcaaccaaataagcgccagcaatcaatcgtgttgtgacttctcacagcgtaaaaaaagcagtcgggtcaacgataatgactcggctgcttttgacttttggaaaaggttattaacactgccataagtggcggacttgagcttcaggcaaaaaagcgtttggcaatttcttcgtaagttttaatcgctgtcgtgtagctatctaaatcaacatgttcgtcaatctgatgactgaaatgattatcgccgggaccatagacaatcacgtcaaactggttatcggaacggatgaattctgacgcgtcggttccgccaaaagccaccgctaactcggctggcttaccagtcacagcggcaatggcttcgttagcggttgtcacgagatgcccgtttttgtcagagtgtaccggcaaaaaacgatgtaaaacgttcaacgtcaagttagcggcggtggctttatttgcctgatcgactaatttttccaataacccgacgactaattcgatatttgctgcaggagtcgggcgcaagttgccgcgtaagtatgcatgggcaggaatggtgttgacttgatcgccgcctttgatcacggtaatggagtggcggaatggaccaaggtcaggatcatcaggggcctgatcaaaggcgtgcggttcgcgagtagaaaatgccaccaacccttcaattgcgttaacgcctttttccggccgggagctgtggacggaaacgccttcgctgtcaatttcgtagttaaccgttccgccgtgtgcgtattttagcaatttgttcgttggttcgcctaccacgagtccggctaagtcatcggcataaccttgttcggtgagttggcgcgctcccattgcaccaaactcttcaccgaccgtggccatgaaacgcagcggatgggcaaagccgctttgcttaaggtggatcagtgccaaggtcatggctgctagcccacttttcatatcatcggtgccgcgaccgtacatggtgttgttcacgatctttccggaaaaaggcggataggtccaggcgttctcatcgccgggactcaccacgtcttcatggccggtgaagcctaatacgcggtcaccgtgattgagctgggcgactaaattgacccgatcatctttgtatgggatcaatttggttggaatatcggccgcttcgagttcagcttgcaaaacgcgggctactgcaagttcgtttccatttgcagagtcaatttggattagtttttgcaaaaacgcaatgggatctgtcatgtttgatcatcctttccgtatgccggctgtgtgattggcgatttgaaaatgtcatgtcggtgttgaagacagcttacactctttttgaattaaaattcaatgattgactaccaagaaatttgtgctaaactcatgaatacaaacttgaaattgatgataaacggactgagtgagtagtgatcgcaagacagtacagaaaacctgtagtgatgagagcagggttgtgagtgatcatgaacatggcttagtgcacacggcacaccgagcatttttgcaaggctgtgatggttggcgcccattatcgtgctcccggatgaatacgtccggtgagtgggtcgcgtttttcgtggccaattagaatggtaccgtgggccaaagctcacttctaacagcaactgttaggggtgggctttttttattgggttcattgattggcgatttcaggtaaatgcggcaagttaataaatcgtacttggtgcaaacaaatgaggaggatgcaggatgaagcgtatctggaaaatttttgcaacggtggttcttttaggattgattttggtaggctgcggaaaaagtggcagtcaagctagcagtcagaagcagacaacggtcaagattggggttgtcggtgctgataatcgcgttttaaaggcagtcgccaagaaagttaagaagcaaggaatcaatattaagattgttcagttttcagattacaaccagcccaacaccgctttgaaagatcatgatattgacttgaacttattccagcatcaatatttcttgaataactggaataaaacccataacgctgatttggttagcattgggcagaccattattgcaccgctagccatttattccaaaaagatcacgaaaatcagccaaattaagcaaggcgacacaattgccttaccaaatgatccgacaaatgaaggtcgtgcgctgcaattgctgcaaacagctgggttgatcaagcttaacaagaaagtggctttgtcgacaacgcgcgatgtgaccaccaataaattgaatctgaaacttaaagccgttgatgctgctcaaactgccagctctttaccggatgtggcagcgtctgttgttaattccggcgttgctcaggatgctaagttaaatccgaagaaggcagtctttactgagaaagtgaataagcaaagccaaccgtggattaacgtctttgtagctaataagaaagataagaataacgccacttacaagaagattgtgaaggcttttcggactaaggatatcgctgatttgattgaaaagttgtatcacggaagcgaagtaccggcttggacgcagaagttttagttagatgtttgttttgggggatgtgagcggggttcatgcttcaccatgatgagattccggggcgtgtaagtacctcgcttgcaatggtcaaatccgggtcgtcacgactgaggccgcttatgttctggcttacgcccataacgcgctccccggcgtagaagtctgcgtgtaaggaccttggtcgcaatggccagacccgggacatcacgcccaaggccacaagtccgcctttacgcccataacgcgttcaccggcgcaggaatctgcgtgtaaggacctgagtcgcaatggccaagagcgggccatcacgtctgaggccgctgacattctagcttacgcccataacgcgctccccggcgcagggacctgcatgtaaggaccttggtcgcaatggccaaagcccggccatcacgaccaaggccacttacactccggtccctaaccgcgccggctcgcgcttactttactttttacttgacaatgaccacttttatcgtctagaatcgatttaattcatttagggaaacgaatgatatgagtgagtagatttgatgagactgtacagaaaacctggttggctgagagcagggtagttgattgaattgaagatggctcattgatcggcatcgctgagcattggttaagcgatgatggctggcggtcattattccgcacacaggttattgcctgttactgagggcgctttggcgtcgaattagaatggtaccgcgagttaactcgcttctaaaacattgttttggaagcgggttttttttaattttcggcaaattgctgacacatattgtttgtgacccgaacgaggaggaaaaagtttatgaagttttggaaaagagccattataacccttgcattggttttacctgtcttcgtcttggcggcgtgcggtaagtcgtcatcgagttccagtaagaatgagacggttaaagtcggcattatgagtactgacaaagaaatctggaccgatattcagtcccgcttgaagaagcaaggcgtcaccattaagttggtgcagtttactgattataaccagccgaaccaagcacttgaagatggcgatattcaactgaacgcttttcagcatcataatttcctgaataactggaataagaagcacaataccaagattgccgatattggcgatacttatatcggcccaatgcgtgcgtattccaataaaatcaagtcacttaaagaggttaagcaaggcgatcagatttccttgccaaacgatccatccaacgaaggccgcgcattacaacttttggcacaaaataagttaatcactttgaagaaaggcgttgcttcaccaacgatccgcgatattacttcaaacaagattaacttgaaattcacggaactggatgccgcccaaacagcacgctcattgaacgatgtggccgttgcggttgtcaacaatgatattgccgcagcagctaatctgaaaccgtccaacgcgattgccgttgaaaagattacgagccaatccaagccgtgggtcaactttatcgctgctaagtcttctaaggataagaacaatgcaacctataagaagattgttaaggcctatcagacaaagcggacagctgaattgttgaagaaggtttataaaggttcaacattaccggcttggaactataagttttaattagaaacggggacaattatgtcagatcaagcagttgtgactttaaaagatgtggacgtcgaattccacggtaaaaaccgttcagtccatgccgttgaccatgtaaacctaaccgtcaaccgcggcgacatttatggcattgtcggctattcaggcgccggtaagtccacacttgttcggacaatcaatttactgcaacggccaactggcggcagcattcatgtattaggacaggatatgcttgctttatcaccggcagaattacgtaaagaacgtaaacggatcgggatgattttccagcattttaatttgatgaatagccgcaccattgccgataatgttgcgtttccgctaaaaggtatcaagtccaagcaggagattcaaaagaaggttgctgagctgttagacctcgttgggttgacagatcgcgccaatgcttatccggcccaattatccggtggccaaaagcagcgcgtcggtattgcgcgggcgcttgcttctgatcctgagattttgatttcagatgaagcgacgagtgcgttggatcctaaaacgaccagttcgattctggaattactgcagtcgctgaacaaacggctgggactgaccattgttctcattacccaccaaatggaagcggtgaagcagatttgtaatcgggtcgccgtgatggatgccggcgcgatcattgagcgtggtgacttattgcaagtcttttctgatcctaagcaacagttgactaaagatttcattgatacaactttgcaactggatcaggcaattgaagccgtgatgcagcagccggcagttaagaatctgggtgctaatgaccggctattgcgcttaacgtatgtaggagattctgcggataagccgctggttgccaagttgtttgaaagctatcatgtgaccgccaatatcttgtttggtgatattcaaatcctgcaggacacgccttttggcaatctgattgtggtgttatcaggtgctcaagcggatgttaatgccgggattcattatctggaacaacaggatgtcaagattgaagacattcttaagaaggaggcctaagcagatggcacaattttttacaaaatattttcctaacgttgttcccatctggtccggtgatggcggcgtaactcaagccattaacgaaacgctgtatatgactgctttaaccgcaatcgtggctggtatcttgggaattatcatcggcatcttgctagttttgactgatgaaggtgggttgcttgccaatcatccgttttactttattttggataaattggttaatattttccgagcggtccctttcatcattttgctggcgattatgacgcccgtgacccgagcaattgttggtacggggattgggccgactgcggcattggtacctttaatcgccggcacgaccccgttttacgcgcggcaggtacaaaacgcgttgttaacggttgatccaggtgtgattgaagcggcagaggcgatgggtgtttcgccattaggaattgtctggcgggtttatctgcgtgaaggactttccgaattgattcgggtttcggttttgaccattatttccgtgatcggcttaactgcaatggcaggcgcggtcggtggcggcggcctcgggaaccttgctatcgccgtgggttaccaacgttatcaatatgatgtgatcatcgtatctttgatcttcatcttggcattggtcttcctagttcaattcatcggcgacttctttgcccgcaagagtcatcattagaatttaagctgatttggcagcactctcgtttgagtgctgccttttcctttacacgcgtccaaacaaccatgaacgattaactttatagaaagcaaaaaaagttgccgtgtttgccggtatactgtttctgacgtaaaatgaccctataactaaaagtcaaatccattcgggggtaacgttgtgcatacacttgagattaaagatttacatgtcaaaattaaagctgaaccagagcgtccggagattctgaccggcgttaacttaaaattagcaaccggcgagattcatgcgatcatggggcctaatggtacgggtaagtcaacgctagccgaaacgattatgggcaatcctgcttatgaggtaacgcaaggcgacattttgattgacggccaatcgattctcgatcttgccgtggatgagcgtgcgcgagccggattgtttcttggcatgcagtatccccaagaaatagccggcgtgacaaatgctgaattcattcgggcggcaatcaatgcgcggcgcccagaagatgaccagattcgcattactgactttttgaaccaattggataaaaccatggcaacgctggaaatgccggagtcaatggcggatcggtacctgaatcaaggcttttccggcggtgagaagaagcgtaacgaaattctgcagctgatgatgattcacccgcattttggcctgctggacgagattgattccgggttggatattgatgcgctgcggattgttgcaaaaggcgtcaacttgatgcgcggtcctgagtttggcagcatgattattacccactatcagcgtttactcgattatattattccggatgtggtgcacgtcatgaaaggcgggcggatcatcgaaagcggcggcccggagctcgccaaagaactggaaaagactgggtatgaacatcttaaagtaggtgatcagaatggttgagaccaccaccttaccagcacctaatctgccgaaatttccacttgcacgttatttaaaaaatcaacctgatgccgttgaggatcgtgtgattttacatgctcctcaagacattgcctatgctgccggctccagcgaagcgcaacgatttactcccaaaacgagccttgatgcctggctgttgcaatcacctcaaggcgcaacgactatcgatattccagcgcattttgtcagtggggacgatccgattgtcttaactggtcccaagaacgctggcggcttgttgtatgttcatgttggcaagggggctaacgtcaccgtccaggaaaagtgggctagtggcggccatgtgctgggtatttggttaatgctagtgattgaagctgatgctcaggtcaattggttaagctatgatagtttctctgcggataccgttttggttaatcgcaccgccactttggctgacaatgctaaacttaactggacattagccggtttttcgcataactccggcctgaatcgggttgacgtccgcttattaggtcaaaatgctgaagcaacggtaaatgtcggcgtgttggcttcagggagtcagcgtgtcagctacacaacttctgtcaccaacgaagggcagcacacagttggccatattaaccagcgcggtgtcattaccgggagcgcccatttgttattcaatgggattggccatattgtcaaaggcgcccggggaagcgatgcccagcaggaaaatcgggtactgatgctgtcgccgcgtgctgaaggcgatgccaatccgattttgctcattgatgaaaatgacgtcaccgcggggcatgctgcttcggtgacgcgcgtcaatgctgatcaactctactatttaatgagtcgcggtctttcagcaacgttagccaaacgtctcgtgattcgcggctttttggaaggcggtttggctgagattgatgatcagcggctaaagaaagaactgtttgcaacgattgatcgaacgttggtggctgaagatgcgtgaacaatttcctttttttaaggctcatccaggattggtttatttagatactgcggcgacctcacaaaaaccgcaagccttgctggatagcctgcaaaactactatattaatgaaaatgccaatgtgcatcgcggcctttataagctggcttatgatacgactgaggcctatgaaggtgtgcggcaggaagtcgcggattttctgagtgccaaaagtgctgatgaaatcatctttacgcgcggcacgactgatagcctgaatctggtagcgagtgcattcggaccgcatgcagttcctgaaggcggacggattgtggttagcggtgcagaacatcacagtaactttattccgtggcagcaattagccaagcgtcaacatgccaagtttgaagtgaccccagtgcatcctgatgggatggtggacgtgcctgccttgcttgcagcgattacgcctgagaccaatttggttgccatcgcccaagtgactaatgttgccggtgatacgctaccgattgccgccattgccaaaaaggcgcatgcagttggcgcggtggtggtggttgatggcgctcaggcagtggcacatttgcccgttgatgtgcagacattaggtgcggatttttacgctttttccgggcataaaatttatgggccaacggggatcggggttctttatggtcgcgctgatcttctagccaaaatgccgccgattcagtttggcggggaaatgatttcagaagtccgcgatgatgtcagcacttgggcagaggggccgattaaatatgaggccggaacgcccaatattgccggtgtgatcggattagggacagcgctgcactggtttaagcaaaatgttgatgcagcggtattaaaaaccgaacacgacctgtctgatcagttgcgttcagggttggcggcgataccggacgtcacgatttatggcaatcaggcgagtctggcaacggtatcatttaacttggcaggtattcatccccatgatctggccacctttttagatgagcagcagattgccgttcgtgccggccatcattgcgctcaaccgttgatggcacgattaggggttccggcaaccgttcgcgcaagctttggcgtttacaacaatgctgatgatgttgctaagctagtcgaaacggtgcaggcggcaaggaggtatttccatggcgttgactaaactggatcaaatgtatcgtgcggtcattcttgacgaggcccaacacccgcggcatcatggtacgttaaccgatttcgatcatgaaataaccgtccgtaatcccagctgtggcgatgttttgcatttgcagattcgcgaacaggctggccgggtggatgatgttgccttttccggcagcgggtgtacgatctcgcaagcaagtgccagtttgatgacggagcagattttagggaaaacgcctgcagaaattgagcagatggtcgagactttttctgacttgattatcaatggttcggtgcctgacgcggagattctgggggatgctgctgttttaaaaggtgtccatcagtttccggcgcgcatcaaatgtgccactttagcttggaaagcagccgcgcaagttttgacgcagagaggtgaaaccgatgactgaaaccaaaaacactaaaaataatgaagtcgttgccgcggatatcgactttttaccggatgagaatcccgctgatttcaaagatgatatcaagccggtttactcgaccgggcgcggtttgaccgaagacacggttcgggctatttccgctgaaaagcatgagccggattggatgttggcatatcggttaaaggcttatgccacctaccgcaaactggccatgcctaactttggaccggacttatccgacttggacttagacaatatgctgtatttccaaaaggccacagatcgcacctatcgtgactgggaagacgttcctgataccatcaagaaaacgttcgaccgtctcggggtgccacaagccgagcgaaaatatctagctggggcgagtgcgcaatatgaatccgaagtggtttaccataatatgcgggatgaatttgaaaagcttggcattattttcatggatatggattcggccttgaaggaatatccagaattggttcacaaatacttcggaaaattggttaaacctagcgacaacaagtttgcggcgctcaacggggcagtgtggtccggcggtagttttatctatgtgcctaagggtgtgcaaaccgatgttccgattcaaagttattttcggattaatgccgagaacaccggccagtttgaacgcacgttgatcattgttgaacccggcgcacatgtgaactatgtcgaaggttgcacggcgccgaactattcaagcgacagcctgcatgccgcggtggttgaagtctttgtcaaaaacgatgcttactgtcgctataccacgattcaaaactggagcaagaatgttttctcgcttgaaacgaagcgggcgcaagcattggataatgccacgatggaatgggtcgatggtaatctcggcagtaagacaaccatgaagtatcccagcgtttacttggatggtaaaggcgcacacggcaccatgttgagcattgcggtcgccggcgaaggagtcgatcaggataatggcgcgcgtatgattcacaatgcccccaatactagcagctcgattgtgtccaagtcgattgccaaagatggcggcgcggtggattatcgcggcaccgtgcgtttcaccaagaaagccgacaacgctttttgccacgttgaatgcgacaccattttaatggacgaaaagagctccagcgatacgatcccgtacaatgagattcacaattcaaccgtttcaatggaacatgaagctaaggtttcaaaggtttccgaagaacagctgtattatttaatgagtcgcggcatttctgaagccaaagcaaccgaaatgattattatgggctttgttgaacccttcaccaaagaactgccaatggaatatgcggttgaacttaatcgcttgatcggcatggagatggatgggtctgtcggttaatgctttggtggcgcggtttgtcagactttcaggtcaccttccaggcctttcaggtatctggcaaaaacagctaagtgcaagtttttaagatgtatttatcagtcaaatatcaatgtagcctcagttgcggatggagccacagtgatgtttggctatttttttgtataaaatattaggcaagcctaactttttgggctatgatagatgcggcaccaaaaatgattctattgagggggctgcagatggataactacgacaaggcaagaaaggtcttgcaatcaatggcgttgtccaaaattgcacaggaaacaggcatcagtatcggtcagatctggcattaccgggatcgctatgagggcattcaaaaggcgccaccggcatatgttgagcgaatcgcaagcttgtatcgaaaaaaacgggtctagttggggcatacgctggtccggatacgaaaggggagactttcgtaagatcggttggactgattgaaaagtccggcactttgagtgtggtgactgatcagtcttgataggttgacaacgtcgataaggctcaatgactcagcaaagtgggtcattgagccttgtcgacgtttttgcaggtttaatgatgaccatggttggatactgatgcgatttagcaggctggctcacgttatgtgggggtgctacaatgaatgaatgtatgaatactcaccttaagctaaagaatgcggctggggtcgggtagcaatgtagctggattaataggaggcggatgatggctgaggacttggagcatttcatcaaggcgatggcgctggggattccaaccattaaaccggatgagaagcgagcatttttggggaattttcgcgaacgggtggcgatggcagtgacgattcgccaactgcgcgatgcccggatcaccgcaatgcttgattcagtcttgaagcgttaccccggttaccgaatatttttaaacggtcggatgggtgagagcttggtgaatcagtatatgatgcaggcgctggcacatcagtatccgtttacgatcatgaatcagcccggtatgcgcgtgaccaagcgggtattgccgacagactttggatgggtattggcacatccgacccagaaaataagtcggccgattttgttataagtaaacatgctaatcatgaaacagctaaggattttttagaggaggatcattttgacgcaacttgataccattcaaaccaccgtgcaacagttgcggatttcgttgaatcaaggcaagatcttcgcgactttaccggacatgctgggcaaagtcatcactagcatcgcgactgagccaaaaacgagtctgaaaattccccgggatgataaaacggctgtcgccagaattcgggctattcaaaagcgggttaaacaaacgagcgatccaagtgtgaccgatgatgaaattgcttttttggtcgcacacttagccagtaccaatccggctgttcgcgataaaggcgtgtttttcctgtttaacgatttgtttcaggctgaggcgttcacgaatgaacaagttaaggcactttttaagcgcttgcaggcacccgacattttgttcagccacatctttgaaccggaaaatgacgcgatttttctgcggagttttgccgttatgattctcagtgggatgatctacgcggatcagaatcgttaccatgttcttagcaaaaatgattatttgagcaccgtacaaaatatcggtacttatattttgctggagaaggatggtcgcggttatgttccgaataaaggctgggcgcatgcttttacccatatcgggaatatgcttgaggaattgagccaagtgccggttcttccgcgttcagaaaaggtctttttgatggctgccgttgttgaggcgtggcgacgggtcgaaaccccgttgatttttggagaagatcatcggctggcgctttatttcagtagcttaaccaacgtcaatcagttttatagtgaaacctttttgatgtgtctaaaaaattggcaacacacgctggtcaatgtgcggccacaggaatcataccgtttttgggtacagtggtataatcgcaatcgcttgttgcaggcattaacgttgcgcgctgatttaccgcagccgattgcggattatattcaacagattgttgatcttttttgagcgttcgaagcgccaagtcattaagatatttatttttggtattaatcggcgttgcagctgacgttcgccgatgtgagctggcaccaaatgattaaaactgtgataacacggttttgaatcggttttttattagaatggtgtgtgctgcaacggcacaattaggttgacgtgatacttgacgaagcacaggtgaaacatcctgcactaaatgcagatcagaaaattatttaccgcgttaaaaaaagcagatcaaggtatacgtagtcgttgcccaggtgaagatgctttcaaaaaaacaaatgggtaaaaagcatgcgatcatttaactgatacttgaatactatgggctaaggcttaaatgagattaaaatcgagctgatgaacgtattagctaacttttaacaatttaaagatgactgaccaataaaaatagttataaatgattataagtggatagatattatagtatattagttttaacgttgtgagccttttcgttatcaaagctcaaaatttaaaaaatttttttacaaaaatagaataaatatcggttgttattattagcttttaaaaccagttatccgtataattgacactaggttaagggggagatcccgccgatttctatgttgatatgtaagaaggaacactggggagtgataagtgtgcgaaaggagcagcaaacgctacggattttgggggataaagtccgctactatcgtaagttgaaaggcctatctcaggcggaactggcagcaaatatctgtacgcaagctaccattagcctcattgagaagcggaacaaagtaccaagcatgaatattctgatgcggcttattagtcgactaggtattcaactcgatgatattgtcgttgagcatcatgatcgggctcaacaaatgcttaatgcgattgattatcagattcaccatcaccaatatgcaatcgctgcagacaatctgagcaaaattcggttcgaaaagattaagaatgaagacgatcagaaacggtattactactaccaaggtattgttgagttattcaagaacaatgcccctgatgaatccatctacttttttggtcgggtcttaagcccgcttgttaattcggagcgggatttatacggtattctagccacgcttggcttaggcttagcatatgcggacaagcatacctttgatcgttcgcgggtctatattgatcaagcgctacgaatgttgaagcatgtaccattgtccgatagcaaatatctcgatattgagttgacgatttattggcatattgcccgcgtttactatgagttaagtgacttcaaggccgttttgaagtatgccgatcatgggattcgcgaagcagttaagcacgataaactgtttttgcttgacgaactgtttaccctaaaagctcgtgccatgaaactactgggcgatccacaggcagataagatttaccaaatcgcgattgcctttgctgaagtcagcggttcaacaacattagctgctgggttaagtgcagagatggcagcgcagaagcccaatattgaaactgcataatccggttatgcggtgatgtttaaaaatacctgagatagtcgtcttgcagcatcgttgctgcagctgacgacattctcaggtattttttggtgcgatccggcatctttgccgaggcgcaagatggcgtgattaacttacaaaagtagttcgttctcgattaaaccatttatatgatgaagtcgttgatttaactaatcatttggttcgtgtggggtaggcttttttgtacttgctagagccggcttgtttgataaatcggtccgaaccaccaggacgtcgcataaggcgtttcgggtgacatattcggttaccgaaccaataagcagacgttcaacggcatttaaccctgtagccccaatcataatgagatcaatattcttagctttggggatgtcgcgggcgatgattgtttttggcgcgccgtactcaatactgaaactgactttttctagtcccgcttttttggcctgatcgacgtaaccttccatggtggtcttggcattttccgtaacttgttcaaccattgcggaatcaaaactcgaaacattttgaaacgctcgggtatcaacaatatgaatgagaattagttctgcttgatttcgttttgcaacggcaactgcttttttgaacgctagctcggcttcatatgagccatcgatcgcaaccaaaatatgttgatattgttgtaacattcctcatcacctctaccttcattgtacttgattccatcatgaaattaaatgaaaagcgtttcacaacttgatctgggtaagactgataaaaatgaaaatggtggccagaaaagccccactgaccagaatcaccagatttgcccaagttgggaaggctaatcctccaataatggcaaagacaccgaccaccgtaaaaagaaccgtaaagatcttcaaaaaacgggtaagggctggggctggttttttgatcattaaaaagttttggttgcggtgacgccatgtataggcggctaaggcaaatacgaaaagcgcatagatgctcattaaaatgagtgtcacgggtaaaatccctcctagctgtttggttctattatgccacagtgagtgggagtgctggtggagatttttgtggtggagtgtttgggtgggggtggttaagttctgatacatgagagccggtttcgctcataacgcgttcaccggcgcaggagtctgcgtgtaaggacctgaggcgcagtggtcaagtgcggtcatcacgcctcaggccgcttaagttctggtttacgcccataacgcgttcgccagcccagaaacctgcacataaggaccttgaacgcaatgaccaaaacccggtcatcacgtctgaagccgcttgtgctctggtttacgcccataacgcgctccccggcgcagaaacctgcgtgtaaggacctcagacgcaatggccaaagcccggccatcacgtctgaggccacttacactccggtttctaaccgcgccggctcgcgctcaccacaaaaaaagccggcgcttggccggccaaaaacatgattggtttttatgaaagactaactggtgccgttttcttcccggatcgttgaaacccgctgctagctatgtgggcccagacgccaaggacattagccgctaagtgaaatagcagcaccgtcaatgactcttccggtcccaaggtctcgatactgttcggtcaactgatagttaaggaagcgcgaacaccttagaactttcaccgttatagtagcacgagaacgaccattcgtgcaagcgcaaccgctttcgttactttttcttcacctttttggcttcgtgttgccagcttttaagttgttgctgacgttgggcaagtgcagcttcatagcgacccgttgtcttgggttgatagtattgtttatttttgaggttatctggcaggtattgttgtgccacccagccgttggggtaattgtgaggcaacttgtagccttggccgtgtcccagttgtttggccccgcgatagtgtgcatcgcgtaagtcatcaggaatctgaccagcttgtccactttcaacgtcagctagtgccgcatcgattgctttgatgccagagttgctttttggtgccagacaaagatcaataacggcatcggccagtggaatccgtccttctggtagacccaggcgttccgcactttgaatcgcggttagtgttcgactggccgtggttgggttggctaaaccgatgtcttcatacgcaatgactaatagccgacgcgtaatgctatttaaatcaccgatcgcaattaaacgtgccagatagtgcaacgcggcgttaacatcagaaccgcggatcgatttttgaaaagccgagatgatgtcataatgggcgtcaccatttgtatcaccggaaatagccggtttttgaaggctttgctgaatggttgttaaatctattatgatcgtgccgtcacttttagcaggcgtagagagtaccgcaagctctagaccgtttagtgccgcccgcaaatcgccattggtggtgtgggtcaggtaatcgcgtgcttctggcgttaagtcaacctgatacttacctagtccgcgtttgtcgtctgcaagggcgcggtcaatggcggttgaaatgtcagtcggggttaatggcttgacctgaaaaatctgagttctgctgcgaatggccggttggatgttcatatacggattttcggtcgtggccccaatgagaacgatgcgcccactttctaatagtggtaatagaaaatcctgcttggttttgtccaatcggtggatttcatcaagcaacagaatcacggttccgctcatcttggcttcttcggcaacgatttgtagatcctttttggtatcggtagcggcatttaagattcgaaacgcatattttgtgctgccggcaatggcactggcaatactcgtcttaccagtaccgggcggaccataaagaatcatagaactcaaacggtgcgcactaaccatgcggcgaataattcgtccgggaccaacaagctcttgttgaccgacaacttcatctagattttgaggacgcatgcgaaaagcaagcggttgttgcaaaaagatccctcctaaaaagtgagcgtggaccagcgcggttagaagtcggagtgtaagtggcctcagccgtgatggcccggttttggccattgcggctgaggtccttacacgcagacttctgcgctggggaacgcgttaaagaaagtgagcgtgagccggcgcggttagaagtcggagtgtaagcggcctcaagcctaaatggccgggctttggccatttaggcttgaggtcttacacgtagattgctgcgactgcgagcgcgttaaagaaagtgagcgtggaccagcgcggttagaagtcggaatgtaagtggcctcagccgtgatggcccggttttggccattgcggctgaggtccttacacgcagacttctgcgctggggaacgcgttaaagaaagtgagcgtgagccgagtctacgtcgacgatcacctcatacgatcacctgacacattaaaaaatcatattttaaaattcggctgcttgcagttctaacagtcaaaaaatgctgtaacccttacaagcatgctgttaaacctgccggctgcgtgttaatctaattttaaatcatcaattaaaggaatgacacattgtgaatcattattggcaactgattcaaaaagaacatttgtttggtttggccgcccagacgcgaatgggtgtgattcgaactgtcaaacccattctgccggcagaaaccaacttaccgcagtggccgcaacgtagccgccatgctttggttcagccactttctgcttcagtgttgcaaatcgtaaccccattactagacgattttcctgccgttattgaccagttacgggctgggctaagtcgaatttgggcggcattaccggaagcagggcacttatcggcttttaccgcggaaaaagtgaaccagcaaacggtccggatagttttaccggaaacactatttgaacggttgtacacagcagagaattttcagggccatggtccggaatatgttgcctatcgtaatgaagtttatcagttggtagcagacgggttaacgcggcagttgccattgttgacttacttgttttctgcttctccagctaacggtcaccgcgcatttttgccgtcaccggatcaggaacggcaactggttcaaaaagtgacggatccagaccacttggatcgaattcttgcgctggacgttttggtggagcttgatccgtacgctgctagcgggatcacgacccaaatgctgacattcttgcgtgatagctgctggtttgcgctaagtcaaccggccattccggttgcagcggcaagtgaagtacgccggcatgctgtcatgcaggcgcggacaattgcccagatggcacctgatgccaaagtcgccgagctgccggcaatgctggatgcgatggcgacatggttaaatcatgttggcattgatgtgcaacaaaaacaagcttttgaattgatgcagacgcgattagtgaagccggaaacgagccttgccagtcaagttcttgcaacgtttcatgaccaaacagctgcggatgcgtcattgagtcggcaagcacaggcggacttaaccagtaccaatgagttgccggggatgacagatttatcggaaaacacccaggcattgttacaagctgctatggatggggggtatcagttcacgatactggatcggcaacagaacctggtgcaaattgccacggatacccagacacaagtcattgcagacggcgttgttaccaagtataagccagccaatgccatgatcgttgccactcatcggcacacagccaaacagttgctggccgcagcaggaataccagttgcacgtggggctaagtttactaaatggccggatgccaaagcagcttttgagcacagctttgcgcataaaagtattgtggtgaaacccgaggcacgcagccaaggcgaagcggttgagcagttttcgataccaccgactgaaaagcagtttgaccgagcctttcatgaagccaatcgccatcatggggtgctcattgaaatgatggcacgcggcacgacctaccattttaccatcatcgggcaacaagtgctcagcgtcttggaaaccgcagcagctaatgttgtaggcgatgggcgcaaagccattaaggaattgatcgccttgaaaaatggtcaccgcgcgacttcccggcaattgcagcttgatgctagcgcgcgccgtcagttaaaggcacaagcgttgacacctgagactgtgcttcaacgcgggcagcaggttttcttaaccactgccgcgcatccgcaaaccggtggcgatttgtatgacgtgacggacgagattgatgacagttacaagcaactggcgctaaaagctgccgccacacttgatttgccggtagcagctgtcgacattgtgattgataatctgtatgcaccatatgatccggaggcagatgggcaggcgaacgtaattagtgtcaatccggtaccggatctcgctgcgcctttgcatccggacatgggcgaatcacgcgcacttgccccggcattgctaaactggctgtttgctgtgagataagtaaacgaggtcatattaaaaccgacctcagcgtggtaaatttgcttgaaggtcggttgggtgacaccgttcatgatcatgcttctgcgcgttacggtcacgatgctgacatttaggtgcggtcacactccattatatttgttaagttgcgccaaacgtctttagcggttgcttaaataagttaaaaccactttttcttaggcttttcttgcgtgtcgtcaagtggcggcaaggtgatgttagcctgattgatggcagtggctgccacaataagcagccctggcgcggtatcggcagtttgggccgtttcgttagcaaccaatgtaaatggcacattggcatcggtgaggagcttcatgtaaggaccggtaatggcattatcaagtttgccgttgagtagggctttatagttgcggtcatggaaatcttttaataatggggcaacctgatgctgtcgtttgggatcagtcagttcctgattgctgatacataaagcgacccgttcacgtaatgagcccatgtacttgcggcgttcgtcgggtttggtttgcggtgcgccgtatagtgcactgttgagatgttcctgcatattgtcttctgccatgatgaaaagcctccttatgattggtttgatcaaataacaatttaacgatccttggtgaaccgtcttgttgtgtgaacgcgagtcgtaatgttgaaacctgacaacgcgttgcaatatgacctcattgtaacatgttctagtgtaaagaaaggaatgacgaaagggtgtttaccagtgacgactttgcagtttttgctgcgccaacgctgagtgcgcgaatggccttgattcggcaacagttggatccgaagtttacgcaagccgcgcagagcattgtgccattgttgcagacgccgaaccaaccaatctttgcccatattgcccaacatcggcgtcggcataagaacccgccgccaaacacctgggtagccttctccacgagtcgccgcggctataaaatgttgccacatctggcgttaggtttttgggatgatcgcctgtttttgtggctgtcctgtttgcgcgaaagtaaacctgtactgaacgatttttcaggtatcactggtgttatttcgacattacctgacagttggttactggctagtgagcatacagctaaggcaaccgtgccgttaaccgctgcgtcattggcacagacgattgaacgatttgagaccgtaaaaagtgcggaatttctggttggctgggtttatttggcaagcgacccgcttttgcaaacgcctgataagctatggttggacatacaacagcgggtgcgaaccttagcgccggtatttgcgcggttagttcaaaatactgccgctgtccggtaagcataactacttgtcatgatttcgattcttgatgtgatttcaaaaaaagctgataaaaacttagcagtgaaaacatcagggtggtaaaatcacactgattaaggaacgggttgtcggcttgaacgattgaaaacttcgacttcggtcatctaaaggagaaaactatgccagatgtacgttttcacagcgtctttgatattattggaccggttatggtggggccaagtagctcacatacagccggggcagcgcggattggtaaagtagtgcgcgacatttttggcgaaaccccggagacgattacgatttacctttatgaatcatttgccaaaacctatcgcggtcatggtaccgatgtggcgctagtagcagggctgttggggatggcacctgatgatccgcggttgccggaatcgctgaagctggcctatgaccaaggcattaaagtgagttttgtgccgaaaagcgataaggttgatcatcctaacacggcacatattgttttgcaagccggtgatcaccggttagcggtcactggggtttccattggtggcgggaatattcagatcacggaaatcaatgggtttaagatatcgttgagcatgggtcagccgacttatatcaccattcatgacgatgtgccggggatgattgcgcaggtcaccaagattttctccgatcccggcattaatatcgggacaatgacggtgacccgcactgctaaaggggaacaggcaattatgatcattgaaacggatgattatcatgatgatattttggccaaattgaaattattaccgcatatgcgcaatgtcacttactttgagtgatgacgcgctaacaactggttacgaactggctaataaaggagcttatcatgttttataccgttaaagaacttgtagaacaaagtcatgccttctcctcggttgccgaactcatggtgcatacggaagtcgaaaactcaacgcggactgaagcacagatccgtcatttaatgagccgtaatctggaagtgatggaacgctcggttaaggaaggcattgccggggtcaaaagtgtcaccgggttaaccggcggcgaggccaaaaagctgaaccattatattgccgctgaccggttcatgagcggtaagccgatcatggaggctgttcgcaatgcagtggcagttaatgaagtgaacgctaaaatgggactgatttgtgcgacgccgactgcgggatcggcaggagttctggccggtgttttgttggcgatgcgtgatcgcctgcatctgacgcatgatcagcagcttgattttctttttaccgctggcgcgtttggcttggtcattgcaaataatgccgggattgccggagcagaaggcgggtgccaggaagaagttggctcggccagtgcgatggctgcggcggcgttggtttgtgctaatggcggcagtgccgaacaggcagccaccgtcgttgcgattacgttgcaaaacatgctggggttggtttgtgacccagttgccggcttggtggaggttccgtgtgtgaagcgaaatgcactgggagcaagtcaagccatgatttccgctgatatggcattggccggttgcatcagtgtgattccggccgatgaggtgattgaagcggttaaccgcgtcggcatgcagttgccagcaacattgcgggaaaccggtgagggcggcctagcaacgacaccaactggcttacggctgaaagaacaaatcttcggcaaaaagtaattgtgattcaatgacggcacgaaaaatttttgcccggcatgagttttatttaaacggcgttactggcaacaaggcatttggaaagggtcaatcgtgattaatttatatattattcgacatggtgaaacagcaggtaatgtgcgccgcttaattcaaggcgtgacgaattcacacttgaatgcgcgcgggcgtaaacaggcgtttgctttaggcgttggtttgcgcacgaacggtttgaaggtagagcgtgtagtggcaagtgatctcattcgcgcgcaggaaaccgcccagcagatcttattagggatgcaaaaaaagttgccagttgaaactgacagcggtctacgtgaacaaaatgatggcatttttgaaggccgtgaactggaagacgtttcccagaaagtttttcaggttccggattatcatcagctggtcaccagtggcaaagtgccgattgaagcgattgcggacgggtttcatgccgccgataccacgaatcaggcggaagacagtcaacaagttattgcgcgctatgattttgccttgcgtcggattgttgcagcggcggaaacagccggtcagtccaatatactcgtcgtgagtcacggcacggctagcttgttatggttacgtgcacatggaggcgttttgcccaatcgaaccgaactaaccaatgccagtgttagcaaggtgacctaccaagatggccggtttaaagttgcctggctggataatacgagttttcgcgatcagggtttgaaggaagtctggacccacgatgcttgaaaagaaacgtctgcttagtcacatcatcaagtaggcgttttttttgcgcctgtgagtgctggtgaacggagaatcaagtcattttttgcaggtgccctgttattttcgaaaagattgtgcactatctaaatcagccgtgcgcgcgtatacttaaggtgaattttgaagtggaggcggtggatgatgaagctgacagtcgaagcttatcttgccaagttgaccaatttactattagcgccaggcacgcgtgcgtttgagcgccaacagttagtgcgggccaaacagcaggtggaaggcggcgcttctgtcggggcgagctgggatcaactaaaagcaagcttgcgacccttggcgattcgcgataacctgacgccggatgtagccgatttttatcgggcgcagacaggtgattctgaaggtgcgcaaacaacggatattagtgcacattttcagcatgatctggcttatcaggagcgggccatttttgctggtggctgtttctggtgcatggttgagccatttgttgatcagcccggtattcaatcagtcatttctggttacacaggtggggacgtacccaatccgacatatgagcaagtcatcagtgaccagactggccatgtcgaagcagtggagattattttcgatacgcggcggattcactatcaggaattggttgacttgtattttcaattaacggatccaaccgatgcattggggcaatttcaagatcgcggtggtcattatcgtcctgtcattttcgttgccggaccgagccaacgtcaaattgctgaagccgctaaagctaaggtggcggcttccgggcgttatgtgcggccgattgtgacggccattgaacctgctgccactttctggcctgcagaaaattatcatcaggacttttacaaaaagaatccgcaacgttaccggttggttgaaaaaacccgccagcaatttcttaagtttcagcatgcgcaaggtgatttgcgggtgttgctgaaacgccgtaaagctaagtagcttggccgaggggatgatgacatgcaaaaacctaaacgtcattggagcgagcgtgatatgcctaatcttgcgggtaaggttgtcgtggtgaccggtggaacaagcggggttggcctagccatgagcgccgcgttattgcgacatggcgcggcggtgacgattgtaggtaaaaataaatccaaaggcgagctggcggttgttaagttaaagcagcagacgaagcggcaagccattaccttcatggccgcggatcttagtgagcaacaggcagttaaccggctggcaaatcgccttttgcaggtgctgccgcgtttagatattttgatcaataatgccggggttatgatgccggctaagcgaatcgtgacggctgacggcgttgaattgacgtgggcggtgaactatttttccggatttatgctcacgttgcggctggcggggctactagaaaaggcaccgtcagctcgggtggttaatgttgcgtcaattgcaatgggcaacccgcagctgacgtttaaccagtttgacgggcgcaactatcgcccatggcatttttatatcacgtccaaattggctcaagctatgatggcggtcaaactcaaccaactttttaaagcagccggacacgcggtcatggtgaatgcgtccagcccgggactggcggcaaccagtcttaaggtgattcaatcgaaagcaacggcctggcccatgcgactggccgcactgagttttcgggtgctgccttggatgcgccaatccccgcagcaagcagcattacccgcactctacgccgcaactgcacctcaagcagaaggcggggttatctatgccccggcattatggcacggtctgcgcgggtatcccggcttatcggcatggaatcagcgaccagaacttcatgatcaggctttgttggatcgtctttatcgtgcttcacgccaggtgacgggtatttagtctgtcttcgaaatgttcaaccagatgctggggctatgtttttcacaacaatcctgatttaatcaccatgaaaagggtttccaaaattagtacatgttgtggtggccttccctattaccaccaatatattgtatattcaagacttacatttcagattttcttgcggcataataaaaacggtcgttgtcgtacaacgaaaactgaaacttaagggagtcttgttttgtgcaaacgtctgggaattattttagttggttgctgcatcagttaaaaggatggccgcaacagaattattatttattttggtttgcctttgggtgtcagctgatgacgttggtggatgcaaaaattactgctgttaccgtcattacttttatcggcacaaccttaggggtactttgtgtgctggcaattaacgcgaccaaggctgtcaatggctggcttgggttgctgagtgcggcctgctttatttttgttggttataccgcccgcaattacctttccatgttcgaacagattgcttacgtggttaccctggatctgccggtgttaattagtgtgcggacttggaatgacgataccaagaaccatctgaagactttcaacttgcagaaatgggtgttgtccattggcttcaccttggtggtttgggcagtcagtgcgtacttaatcggtcaattcacgaatgatcctcgcccagtttatgatggtatggcatttgcaatttcgttaacaggcggcattgtttgcttcttgcggtacaacaatcaatatttctggtggttgttcagcgggattgcacagcttattttgtgggctgtcacctttgcgcaaggcgatgcgagcttggcaatggcgatcaactccagcatttatgtcatcaatgatatccttgcgttcactgtgagtccttggttcaatcgtgggcgtaagcaacttggtttaaagacactttaaatagcacttttgctattgatgtggtaatgttttaatttgttgtaacctaattaagctaattgaggagcgagatttgtgatctacattctgggcagtattggtgcaggaaaaacgtctttgacaaaagttttgtcagcggatatggaagcacctgcgtattatgaagatgttgaaggtaatgggatgattgccaatatgctgcagaagttctatggtgccggcgctgacagtcgtaaacgaaccggggccatgttgcagattgcatttttgaccttccgttatcagcaattgaaaaaagccgtgacgcaggagaatgcgatcatggattcgtcactggaatcagactttgtgatggcgtcacaattgcataaacatggcgaaatcgatgacattgattacaacgtctatgtcacgttgtctcaggaaatgcaaagtaacgtcaatggcagtccatggaacgggttgccggatttagccgtttatctcaaaatcgatccggatcatgaactcgatgaaattcaaagtcgcggccgggatatggaagacattcgccaaaagccggaattggtcgcatattatcgacgtgtcaatgctgcctatcaagattgggcaaaaggttacacgcgctcatccatgattaccattgaccgtgatcggtatgatttcatgcattctgcagcagatcgggcgacagtgcttgatcagatcgagtctaagctagttgatctaggcaagctatcaccccagacttttgaggcgttacaagccaaacatgcagccggtccaatttcgaagtttgcataattttgatggttgccaccaaaaaaggttccaagtagctatcctgattggcaggatcgttaacttagaacctttttgtttgccgctcatcactaggatttaaaaacagggtaccaaaattacacattgaaaagctgaatcggtgcgttttaaggttttgcaatcattaccgcgtgtctatgctatgattaaatcaaaatgtgagtaggcgtcatccatggcgttttggcttagatgtggtgaactattgaaggaggaaaccattcgtgacgatttatgatcagcatatgcatacactgtattcatttgattctgaagcccagttgcgggattatttagcgcagactcaggcacctgttgtcaccactgagcatcttgaatttgataatcctgatgatggcgggcgtgatgatctgccggattacgccgggatgaaacgaacacaagccgctcttgctagtcactatcaaaacgaaatgttacttgggatagaggcaggctactttgcgccggcagaggaacgattacgcgattatctggccaaccacgactttgatttgacgctgttgagttttcatcatgatgggcagcatgattacctagatgcgcagctggctggattaccggcaaaacagcaactggaagattactttacgcggatgctggctggactcaaacagtttcacgatgcggatgttcttgctcattttgattatggcttgcggctctttgatatcacaccggagcagttggaagcatggggaaagccactgctggatcagatctttgccattgcagtcgcgcatgatcttgcattggagttaaacaccaagtcgatgtatcgctggcacaatgcgcctttgtatgaccaagccatcgcctggtatcagcaggcaggcggccatttgtttacgattggcagtgatgctcatgaaggtccgcattatgaagccaactttaaacaggcactggccatgttaaagcggcacggcgtcaaagaaattgcaacctatcgtcgtcatcatcggacaatggtgccaattgagccgcctgtggttgatgcagataatgtttattgaaattagcgcactaaaaagccgtttccgcagatgatgagcggaaacggctttcgtttacttcaaataagcattgacaaagttgaaactgttacccgggctggtttttagatcgtgcatttttggattaaccatccgcgcggcaacgagttgataaagcggaatcgcgccggcttgattgaccagtagttgttcggcttgcgtcatgtctttaaaccgcgccgttggattgttggcatcagcaccattggccttggccatgagctggtcgtaatcgctattttgccattgaccgtggttgtactcactggtgctggtgaacagatccagatacgtattcggatcagggtaatctgcgccccaagtacttagcaccatgtcaaaatcacgcgtcgatgctcgctgttggcgattcttggccggcacgctggcaatgctgatcttcaggccaggcagattttcctgaagcgttccttgaagatactcttgggttgccttgactgcatcaacgtcatcaccgagaagctcaacattaacattcttaatgccgagttccctaagcccttgattccagagcgtttgggcctttttcttgttatatgtggtgattgtttttgtgcccttaccaacggcagtggcaaaatcggttgagctgtcaggcaattggctcaagtcggctggggtgatgccgcgtgcaacgattgagccgtcagcaagaacatttttaacaaaagaatcgcgattaatggccattgaaattgcttgacgaatcttcgtgtttttaaacgcgggtactttgttttcgtttagttccaggaaatacgtgcgggcgcgtttggtggcgacataaccggtcttacctttttgttgtgcggcaagttggccggttaacgtggcatcatccagtttgccggtgtggtaaaggtcgagtgccgtattggtgtctttgaccacttgaacatcgatttgagtcaggtgaacattcttttgattccaataacggttgtttttgacctcggtccacttgtcgccggtaccggtccaacctttggatttaaaggcaccgtttgaaagcgtgtattcggacttggtgccgtatttgttgccccattcctgcacttttttagcgggttgcgggaagaaggcgacattgtttagcaggctgttgaaatagggaatcggatgttccaacgtgacttccagcgtcttgctgttgattgctttgacgccaagggtcgcggccggttttttaccagcgcggatgtcgtcagcgttcttgatcccggaatacatattggcctgggatgacttagtggccgggttgaccgtccgctgccaggcgaaaacgaaatcctgtgccgtgaccggagtgccgtcactccacttagcatcgcgtaacgtaaaagtataagtaagcccattgttagttggcttcacaatcttagttgccattgccggctgtagtttatgcccgtaatacttgtacaggccattcatggtatcaataatcgcctggccggaaacgccttccgatgccttacttggatcaagcgtttgcagcacatctgattccatgcggtgccagacctgttgtttgctcgaattggaactcgattgtttgccttgctgaccgcatgcagctagaacaattgtgagtgctgccgtgatcataacgagccatttatgttgtgttttcaagtcttgcccctccagttaatagactgttaatagaataacaatctccttacaaaaagcaagcgttttagctcgaaaaaacctcgtattcagccgccctaaagtgggtctcggataaggagtatcgcggggtttagtgtgctggcagcttatcagtccgaaatatcaatttaacggtgaatgagtcgtcatgggcctcaagcttcatttttccgcccattgtagtcgtcagcgattggacgatgcttaaacccaaaccgacactttgcgtggtgcgcgccgcatcggtggtgtagaagcgatcgactaattgatcaacatgcgaaaccggttgtgccgtgtcatttgagaaggtcatgaccaagtgatggctatcttggcgggcaaaagaaagcttggcctgacttttggcatatttaagccagttgccaattaaattctgaataatccggcgcatgagggtttcatcggtttcaagcattaattgatcggtgatggcaggtgtcacttttaatccgctggcagtaagctggtcatagtaatcaaagagttcgtttttaagtaattccgaaacgttaacggattgatggttcaaactgcgggtcttttcctgaatcaggttgaagtccatcagataatgcagatagtagttgactgaacgcaggttgttggcaatccgggcgagggaaggcttgggatcggcttcaggttgacggtcaagtagttgaacataaccggttgccactgtgagcggggttttgatatcgtgcgtcagatccatgagcatttggtgaatctttttttcctgttcaacttgttcgatttgaagttgatgcatcgtattgagattttgattgatgcccgcgctaagtttgcgaatcaaaggtaggttcgtgttacttgtgatccctgcattggtgttatggtgattaatataatcaagatcacggctgatgcgatgaacatcggttatcaccagtaatagcaaggcaaagagtactagacagatcacgataagtaagataaggatgccaagcataatgatttctccttgctaaatcaaacgtacaccgatgccccagattgaaatgatgtatttgggatcatgggcaagttcattgatttttgtccgtaagttgctgatgtgaacgtttaaggtattgtcggcatttaaaaacggctcaccccatacatgttcataaagttggcttttatcaaagacttgatggggatcacgcatcattagcgccaacatgtcatattcttttttaggcagcgttagggtttgctgattaacggtcaccacatggcgcttagggtctaattgaatttcgccgacttttagttgatcgttcgtcgttaccggttggccgctgacttggcgcagttggacttgaatgcgtgctagtaattcgtcaatgtcaaacggtttggtcaaataatcgtttgcgccttgctgcaacagggcaacggttttgactttttcctgaatcgccgttaacaccagcacgggaacttgggatgttttacgaatggttgttaaaacactttcaccggtcacgttgggcagcattaaatcgagaatgatcaagtccggttgttctcgatgaaaggccgttaaagcctgaatgccgtcataagcctgggtgaccgtataagtcggggttagcacatcttttaataaggcctggatatcctgatgatcttcaacaattaatatcttcgccatcagcgtcactcctttcctccaatgatagtgtaagctattaatgcaccttttcacaatttaggattaattaaggattgattatgctggtaattaaggaatgatcgctatgctggttttgtaaagcaaaataatggaggtaaggacgatggatgaaccggttttaacgattgatcaggtcagtaaacaattcggtcattttcaggcactggatcaagtgagttttacggttgaacgtggtgatatttatggcttaattggcgaaaacggggcgggaaaaacgaccttgatgcggctgattaccggcttatccccaatgcaggcaggcacgattacactgctgggggagcgggccggtcattaccagcgcgctttaagtcgagtaggggcgattattgaaagcccggcagcgtttgaaaaattaaccgtcactcagaacttgcgactttgcgccattcagcatggcatcaatgatcaacaggtcattgcagagacgattgattttgtggggcttcaggaaaagcgaaccaccaaagttaagcacctttcacttggtcagcgacaacgattggggctggcattagcaattttgccacggccggattttttgattttagatgagccgatcaacggtttggatccggccgggattatggaatttcgaagattacttaagttattaaatgaagaacgcaagacgacgattttgatttcgagtcatattttgagtgaactttatcaagtatccacccggtttggcatcattcaccatggtcaaatgatcaagcaattaagcaaggcggaattggatcaggctaatcaatcaggactggccattaccgtggaccgggcgacggtggccgcacaggtattggatcagcacggttatcagccgtttgatgtacttgacgaccagcatctgttattacgccaaaaagatgtcgatgcggccgcggtcaatcaattactggtgaccagtggggtgagtgttcaagacgtcagccaccaagccggttcattggagcaattttacatgcgcttgctggggcagactgaaaaacaggagggacaggcatgatgaatcaaattcgcgccgatttctatcgccaacgccgtacactaggcatgtatgtcatcgttcttatcaccatcgcctatgctgtttggtctgttacaagcaagaatatcggcggtgtgacagtacatggggatgacaatcttattgctcaaattgctgcaaaaacgtggacggctcagtttggcgtgcaggccgccaatatgtcggacacgctcttactttatttctttatcggggtctttgtgattgtttttggctatgagtttagccagaaggtttacaagaatacgctgatttcagggatttcgcgcctccaatttgttctggcgaaatacttagtgatgttgcttgacttacttatcttatttaccgttaactttggtattgcgctgcttggcggtttagcgaaggggcgcgcattaggtgtcagctggccaagtgttttgaatactatgggtttaagtattgttgcagccacctttttcctgagtgtcatctttagtctgggcgtctttttattaatcgcgactggctcgatgacaattgccacgattgtcgtggttatttttccgattctcgtaggggtgatccatctaattggagagtggtcatggttgaagtatattgatttcttggcagtttcccagaacttgggcgttggtagcatggaaatgagcgagttgccgccgtatattgcagttagcctcggatttttgattgtgatgatcggttcgtcagcatggcttttgcagaaaaaagagttataacctgagtcactttcaatcatagcttgaataaacaaccagcagaaacgtctcttcagtcggcgcatctgctggttgtttgcgttaatcttcaagtggcgggtgacgggttttgttgctgaaagatcgtcagaaacttttgcgcggttcgcgacatgggcgcatggcgggtccagatcaacgtcatacgggtcgtgagtttaggtgaaaatgggataaatgataaggccatttcccggttatcgagtaaatgatcaaggcccacagtgtaacctaagccaaggtttgtcagtattccggcattgtaggctaaattgaagcgggcaacgatttgcgcggggtcaaaattggaaccggcccatttttcaaacaaggtgacaactggttgtcgttctgaaatgatgagtggttgatggcggatcatttttggcgtgacagccgcgaatttagccaacggatcggttttaggaaccactaatccccagatgttttcaccggaaatcggtgtataggcatatttataagtatcggccggatcaatcacaacgccaaagtcgagtaagccatggtcaagttgttcggtgatttcggccgcattaccactgtagatttttaatttaacatcaggaaatgtggtcaccaaggccttggccgcatgcagaacactgcgattaagcctggattcacccagaccaatggctaagctgccgttaatggcttggtcatcagtcatatcggtgatagcagcgtctgtcaggttaaggatttggcgcgcccggttgacgagataagtgccattagcagttaagctgatcgcccgatttttccgattaaaaagtttggtgccaagttcacgctctagttcctgcatttggcgcgacaaggcaggttgggagatgtgaatcttattggcagcagccgtgatcgtgcctgcgtcggcaattgctaccagataacgtaacgtgcgtaattccaaggccaaggctcctaatcataataaaaatgcataatgatacatactatataagtattatacatttttcagttgctgacgcataatgaactcaatgacgaaagaaggtagatcgtgtgactaaagagaatgatcatgcgggtcttttcggactaggccaagctaacaccgcttatcaacaatattttaaaggccagagctatttgcattcacttgtaggcgcggaaaatgaaattgatgtccatgtcgccaatgtgacgtttgaacctgggtgccgcaataactggcacattcatcatcacggatttcaaatcttgctggtaacaagtggtgaaggctggtaccaagaagcaggcaagccggcacaaaagttacgtccaggcgatgttgtcacgattcacgaaggtatcaaacattggcacggggccacaaaagatcattggatgagccatattgcaattacgaaaggaaccagcgaatggcttgaacctgtcagtgatgaagcatatgcagcattaacggaggttgactaattgatgaagaaacaaacagcaggaagaaaacagttaggcgattttgccccgcaattcgccgcactaaatgatgatgtcttgttcggcgaagtctgggccaaagaaaacgagttatcggcgcgtgatcgcagtttgatcaccatcgcctgtctcatgacgagcggcgatttcccccagttaaaagcacacctgaaaatgggtaaagatcatggcttgacgaaagaggaagttgtagcaaccatcacgcatttggcattttacgcaggatggcccaaggcgtggtcggcaatgggtttggctaaagaagtgtatggcaaatgagcggatgcggcaccatttgagtatttagaaagtgttgcgtgtgaagggcaaatcgcaccgtttggcaatgtggtcactggtcatcggatgcaagaggttgctgattttatcaagggttataacgctgctaaagtagaattaactgaacatatgaaagattaatattgagcgcctgtggggattgtcaaagaagttgatgatctaaccacgggctttttattttacccgggtatgtatttttagatgatgatcaagtcagccctgaaaaatgtcaaccaccgttgtacggctatgcccacggtaagcaacttgcctcggtgaaaaaccggcatgagaattaaattagactaatgtatacttaagaagtaactgatacaaggtggaaagtcagcaaagggacgatggcatggtgttaaaagcggatttttttgattattatcactacaagaccgagctgactgcactttgtcgtgagtatcatttggctgcttccggtaccaaagcggaattgaatcagcggctaagggcggcaatgttaggtgagcctcctgagaccccaacgcgaacgagcggaccgacagccaaagttaatcttggtgcgatcacgctcacgacgccacttgccggatcgggtttcgcgtttaacgcggccgcacgttgcttttttgcggcgtattttaagacatctaagtttgcgttcaccaagccaatggcagttgtcaaacggcaagccgagtcgcggcctgagttaggattgacggtggccgatctagttgcggtttatcaagcgacccgaacaccatcggcgcgcaaacagtttcttgcccataatgtcgaggaacagacttacgagtggaatcgatttgtacgcgacttctttgctgatcatgctactgttgtctttagttctcgattaaaagttgcagcaattctctggaaaaacgtcaaaagatcaatgactcccaagcgttgtacacatcagttattgagccgatatcgtgaggaaatcgcacgatataaattataatttgcgagtccttttccggaagggacactcaatatgcggtgaaataccacgatagcttttcatgacctctttgattttcattttattttagttgaatattcagtataatcaaagccaagtaagcgtaccactttacaaatgctatgatcaaaagtctttgaacaaagcaattacttttgagtctttattactttatttataatgactggaggatgaaatgaaaatcaaatcaggcaccttggatcaagggtgggaactggtagaccgattagatcacgataatgtaaagtcgcaccctttttccgggaagggggctgacttgaccattaatctcattgctaaacaaggcgctcaagttattggcggcgtggcggcgagttcggatgattacgggatcggctatttggagatgctgtgggtcgatccaatgtttcgtcggcaaggaatcggccaggccttgctagtggcagtcgagcaggcgcttttcaaggcgggatgttgcaaagtcagattagaaacttttgattatcaggcgccggctttttatcgcgccaatcaatatcaagcgttcggcaagttgcattatacccatgcagcgttgaccgaatacttttttgtcaaaccattgcagttgcaagtatcaccagtattgccagcgatctatacgttagcctcaggggatgatgcagcgatgacttgggttgaagatcagtttgaggcagagaatttggcgaagaagccgcttttgcaggcaaaaccgggaatcacgttcacttttttggctgaagaagatggacagtgtgttggcggtattttcggctatagcgctatgtatcgaatcggctacattgaagcgttgtggatcgcaccggcgtatcggcgtaaaggacttggcacgcggctggtgaaccaactattggccgcgttcaaggaaattaattgtccaatcgtccatttagatacgttgtcattccaaggtccgcagttttatcctgcgctaggatttcaacaatttggaaccgttgattatcctgacaatggcgtgagtgaattgtttttcgtcaagttgatccaagattgaaaagagatgcagcatggtcagcagcaacagtatcatcgtcacacgtgaaaaagcgccagcaaaaaagcaggccattgtgcgcgaagttttagcagacttgcctgaatggtttgggctacccgcatcaacacaggaatatattgatgcggcggcagctttaccactatgggtcgctaaacaggatgatcaagtcattgggttcgttgattttgataaaacgagtcaagcaacaggtgagattaactgtatgggcgtcaagaaagcttaccaccacaagggagttggccggcaactatttcaggcgttggcggcctttgcgcggcaacatgcacattatctgcaggttaaaacggttgatgaaggtcattatccggaatatgatcgaacaattcgtttttatgaagcgatggggtttgagcgcttagaggtcttcccgcagttgtgggatgcctggaatccgtgtttggttttggttaaaaagttataaagatcgctatggttctgagaacacagtgtttgtgagtctcggagccatttttatttgtggaagactacaaataaaagtgataaacgtcatgaacctatttacatctagtttttaaaactatataatatagtcattaaagctgatggaggcgcaacatgaccgaaaaaattgcaattctcgttgattcaggttcggatgttcctaaaagtgtgctggatgcgaacccgaatatcgcggttgtcccattgaacattacgatgaacgggcataactatttggacgcggttgatattaccccggatgaattttattcggcattggcaacggctgaaaccttgccgaaaacatccagtccttcaccgcatgcagccaaagaagcgctggcagggctgtttgcggcgggttatacgcagattcttgggattacaatttcgagcgcgctgtcagtcacgcaccatgtctttcaactagcggcggaggagtttcccgacaagcagattaccattttggatacgaaaagcatcggcattggcagtggcattcaagttgcctatgcgacctcgctaatcaatgccggcgaatcgtttcagacgctggtggcaaaagttgaagcatcgatcgttaaaagtcggatctatttttacgtgccgacgctgaaatatttgagtgccgggggacgaattggtcgggttgccggattagtcggctcggtcttacatattaaaccggttatttcatgtgatccggaaggcgtttattatccaatctttaaagcccgctcggaggaaaaggcgcttcaaaaactggtcaatcagattgagcaggattgcaagaacagtgatcattatcgaatcggagtcgcgcacggccagaatccaacgctggtgaagaaactagccgcaaaaatagaagaagccacaggacacccggttgattttatcggtgaagtgtcaccatcgttgggagttcatactggaccggggttgattggtgctactgtacaatcgtattaagcgtctatgacgaatggttattttttgcgaatgttaaatgatgaccagtcattaaagttaaaactaattctttgcaaattaaagtcagatagattttcacacataaaggaaaatctatctgacttttcagcaattatcggaaaagattgaagatttatttttgatttaaccataaccgataaaaatgattaacatcgaaattctgcaaacccgaaacttgtgcatcgccaatttccataattgttaaatcaccattgatctttcgggcaaagtcgattgtgaaaaaagaagatttaatatcagcgccttgttttttaatgaattgctgatcgtttgcattcaagctttcaaaattcttcccccaataatcaataaccacaaatggatttctttgccaatagaaaacgtgatattcctcaaatgtcggattgtttgataagtaggtgcctgtctgaagtagcggaacaaactcacggatgacaagaccaccaacaaggttctcgccctgtcgagtaatgaagttatgaatcacttccaaagattgtgaaaagttttgagcatttggaatgtaaaaggcactataccattcgtgctttctgctcttaacaaaatcctttattgtgactggtccggaaaattggttaagcactcgtatgatacctttatcggataaatcggttgtccaagctgatttgagtgtgttagagtgatgggcccagctaggaagcaaatgggtccctgtataggcgtgggtatcagtaagcatttttgctccagaagctaagattaaactattcattttagaatatgtctctggccgtaacatccatccacgatagataactgttgtttcagaaggaaaagacgtattcaactcaagctgattttgatctaataagcaatcaagattaataagccgaacattagtcatggattttgcaaccgtatattcttcggcgtaatctgggtcgggttgagagactcttaagggatttcccggaaacaacaatgttagtttgctagtgtccatttttagaccccactttgaatgatggtgatgacctagaagaggtgtagccatagaatgagctttgaattagtttagccagctagttgaattttatcgaaacaacgccttcatgccaaccacttattccgtttcgccatctcaattgcctcaatccgattatgcacccctagcttactaaagatggccgacaagtagttacgcacggtgccttcagatagaaaaagcgaggctgcgatttgtttggaagacaaaccactggcgacttccccgagaacggccaattcgcgctctgtcagggggttgctttcagccgtgaccatgttcgcaactaattccggtgcgtaaactgtttgccccgtcatcactttccggataacggcgattaggtcatcgcttgggctgtctttcaaaagataaccgttcacttgagcagcaatagcgcgttgaaaatatactttttgggcgaaggtagtcaggataatgactttggtaggtaaagcgtgcgtgtgaatttgatcagcaacatccaggccggtcattttcggcatttcaatgtcgaggatcgcgacatcaggcggctgcgattgaatggcttgccaagcggtggcgccgtcttgtgcgctgccgatgacggttaaatcatcttccaagttgagtaactgcgaaagtgccgagtttaacatgctttgatcttcggcaaggtataacgtaatcatcatcaggcctcctttggcaaagtaagtgaaacccgtgtgccttggcgattatggacaatggaaaaagtgccgttgaccgcttgcatgcgttgttgcatgccgctaataccatttgacccagcgcgaacatagctttttgaatgaccgtcatcttgaacctcaaccagataagcggtaggggtttgatcgaaggtaatgatggcttggtgagcgtgcgcgtggcgaatcacattggtaatggcttcggaaatgacggcgctcaattgggcttgaacggttgtcggccattcagtggcttcattttccccgtttgtcagtaaaaccacatccgcttccgcgagatttttaccttgttccaacatcatttcgctgagggactgctgatgaaggtcgttgacaatggcgcgaaccaattgtaggttgtcgcggctggttttagcaatatcgtctaattcttgggccactcgttccggcgctttgatgagtaacttttttgccaattcggttttgagcgtgatcatcgagaagctttggccaagtgtgtcgtgcaagtcacgcgcgatgcgttcacgctcaccgcggcgaacaaccgcctgcagccgccgattggtttgacttaactggcggcgacggatgactgagcgcgcaagggtgtacgaaatcagcggtgaggctaatggaaaaacaaggtcgctaatattcgcattgtcgagaccaatgacgccaggatgaaactgattataacgccagagtccgatgaacataatcacgtaaaatgcggtggcaaaccagcgaaaatattttcgcggataccgggccaagataaatgaaatctgccatcctgggtaaataatcatgtagttattgaaggcaaagatcgaaaacaagccggcaatgaagagttctagtggaatcgtcaccgccagccaccgatcgatttcattaacgagaatataaacgaccaggaaaaggacccctaagccaatccacagccagtcaatactggacttggtggggatgaactcgctcataatatatggccaataaagcagccacacataactggtccattccagattgctgaaccataatcgaaaactatgcctcacccaatgccacgcctctccgttgttcgtttcgagtcattgccacaacgaccaagccggcaagtaagacccaaacaactatgccaatcaaattggttaagtctactttagcacgtgacgtcagttcatttaagagattgttgacgaaataagtcggcatcagcttgccaattgtttgaagccaacttggcaacatgctgatgggccaccataagccactgacaaaggccatcggaaaagtcagcaagttgctggcaagactgagcatttcttctcgatggatatgtgacagcgcaattccgatcatgagcaaaggcagctgtccgattaagaccacaactatcagccccaaccattgactgatttcaagccgaacgccattaaccccaactgcaatcccgcctagcaccacaactgacagcagactcatcatcaacatccaaaaggtgatggacgtgtaataaggtaaggtgccatgtggagaaagccgcaaaaaagttgtcaggcctttttcacggtcacgtcttaagatagaagcaatgctgaagaaagcctcaattaaaacactgtagacgatcatctggcccaggtaagtgagattgaattgcttgatttctgcagctgatccactcaccatgatcttagtgaagagtaaataaaatccagctggcatgatgattgaaaagaaaatgaatgaggcgtttcggacgactaatcgcttgccgtcaaaagctaattgtgcaaggaatgttttcattttatttagcctcctgttgggttaactgtaggaaaatatcttctagtgattcacgattcacactcacttggtgtaggcggtcaagcagcggtgtcaatgcgcgcagggtctggtcaccatctgtgctgtgaatgacgagtttatgcttgagatgatcaacgcgatcaactgcaggcaatccgttgaaaatgagtagttgcaggtcagtttcaaatgtaatggtggcacctagatgctgtttttgcagttgctggagggagccgtcaaatgtgaagcgacctttttgcagaatcagcaggcggtccgcaatttgttggatttcctcgagataatggctggtaatcacgatggttttaccttcttggcgcaattgctcgatgttgtcccagaatgctttacgcgagttggcatccatcccgacagtaggttcatcgaggaaaagtaagtccggttggttgattaaggcaacggcaaatgtcacccgacgcaattgcccaccggaaagactgccgagtcgctgtgttttaaaaggttctaagcgtaagtccgtgagcaatttattagtgtcaagcggatgatcgctttcagccgcagcaagcttcagtaaatctgcaatcgtgatgccgggaacaaccatgtcgccttgaagcatcgacccgatccgtgccttgctaatagccgatccgggctgctgttcaaaaacgctgaccgcgccttcacctttaagtagtcctagcaaaatgttcagcaaggtggttttacctgcgccgttaatgccgatcaaaccgatgatttcaccggcgtttaccgttaagttaatatcatttaaaacttgttttttaccatagctgaatttcagatgttcagttcgaataatggtgtgcatgtcatccacctccaacatcgatactatgcggccaccatgattgccagtagtcgcgattgtcatgaatgtgatgtgacaaatgtcatgactgacgattttggggggcgggagaagcgcgcggcctttgttggaatgacataaatcgttaaacgagtcatattaatgaggcagcagcatctctattgtgcgaaccgtacttcttgtataatggagggaatatggacgcggattaaaagaggggaatcaggaagatggcagcgacattatcggagcctttgcgtaatctattattagcaagtcaattaggactgagtgtgcatcatcctttagctggctggtcagtgctgacgattctttatcgcgatgccggcagcagcagtgaaccgatcaccttgagttatttagcccggaagtacaacaacgattatcttgatggcctcagtggggaaacgcccattgccgatgacgtcttgaaaaaggtgctcgatgtcctcgtgacgcaagcagggttagttgaagtaagcccgcgaaaagtacgcgcccgcatgcgcagcggtcagtaccatatccgccagtcatatgtttaccggatcacaagcagcggcattgaatacttgaaaatgatgcaaaaagtcatcgatgccgaaagtaccattacggccaacaccaatcggattcaggaatacgtggatctggtcgaaaaactgagtgtaccggttcgttcgggggccgacacccggctttacaatgattttaaaaatatgcttgatgcttatgacgatgtgatgaaaggcattcataaattagaagatgatcttgatgagattgcaaacgatattgcctttaaccatggaagtcaggctgcagcccacttgcagcaaatgttgcgccaagaagcgatcccggcataccggcaaatgttgaatcaggcagcacgtattcaaggtttggctgacgaccgtacttttcctgatcagattgcccattcccagcaggctaaaggggatctggatgctgctcacgctgtcggccgtcaagaagtgctagtcactcgctttcagcggaccaagcaatgggcacagtcgcagctcaatcggttatcgctaagtatgagtccaacgacgaccgcgattgatagtagtctcgattcgatttatcttgtctttaataccttgttaggcatcgtgcgtttacttagtcaggaatttgaacatgctaagcgccaaacgattgacttgaaagcactgtctaagaaaattgatgggttactcgcacattacgcccagctgacgattcctgcccagatcccacggcacttgccggcggatcgtgaagttgatgaccccaatgacttgctagatgcgtctacgatggggccagttcattatttagccaatcccattacaaagcagccggccagtgccgccgacaatccgaccgtcaccgatgatgcaccgagcgagcaggcccaactggcaggactgcgagaatttcggcggacgttgatggtggatgatttccatggccgggttgatcacaatttgacgctcaagacagttatcgcgcgcgatgaaatcgttaaactatttgctgccacctatcacaaagatcttgctgcttttgctccatttggtcgcgcaaccaaatcagtcgaagcattaccggattcgccgccgttacagctgcaagtggcaggcgaagattatgcagttgtgctgccgcatgggttcacgttttcgtttgattaaggagaagaaataagatggcgcaaataactaaacgcgatcaactggtgattaatgaattgttggatcacggggtgtttaccaccacgccgcttgctgccgccacgcaattgagtcgaggtgccattgcggatttaaagaaaccttccgtgcagaaacgaatcggattttactttaagaacatgttcggcatcacgcccgaaaactttcaagaaaatctgctttttctgttgggaaccgagaaactttcgccggtgcaggttcatgttcttttggcaacggttaaaacgatcattaatgagccggaattacagaataatcaagcggatcgggccattgccacccaaaaaatcatccggcaggtgcatagcgaggttacggagttagaggagcgggaattgttgcgtaccgttgatgcactgttcgtaaaacgattcgggttgttcaccccagatcgctttgaagacgattcggaaaatgtaccagcagagattgatgattattgggaggttcatccggatttcaatgaatttgcccaaaacttggtgaattatttggtcaatgtccagtcccaagaggaagtaagcgagattcaaaaagttaaccgtgttttactgacagaacaatttatgagtcctaaagccaatccgcaactttggtcaacgttggctgtcaacaagcaagagattgccgaacagtgggcgcaaggcgggcggtttgttttagaaatcggggatcgttatgcgctgctactggacacgcaacgccagcctagtgttgccaagccttatctagtcgctttggcagtggcccatcaacttggcgcaggggtggcggccgctgatttaaccgcactcattagaaaagtgacaggagaaatttttccgggatttaccattcaacccagccaggtaaaagcagcattattggagaatgatttgatggttaaccaagatgactactggctgccaacaccgattgtaggacgctttttagttactcaggaggaagatataaagggagatacggcatcatgacgcaaattttggtacctgtcagttaccatttacgcaactttaataaatacgccaaattagatatgcaagctgcaaaaaatggcaacctgactttaattggcgaaaacgcggtcggcaaaacgacactagccaactgcttcttcccgatgctcattgatggcgcgattacgacgccatcgttcaaccccgccaagaatacagaaaaagtgtcgcaaagtaccagtgcccgcaatagtagtcgggacacacggacgtttgaatcgatgctgcttggctgggggccgggcgcaatgaaagtacgaaccggctatagttatgtcttgttgcgttctgaccagcgccaggtattgcttggtttaggagccacccgcgtacaagacgatccccgcaaaccaacatggtggtttgtggtcatttcgaatgaaactcaaacaccaatagacttgcaaacgactgataataaaggaaaaagtttagacaagctcggttttaaggccgccaatgcagctctaggcgatcaattgcatgtttttgagcgccctgaagactaccgcgaatttgttgccactcgcgtttatggctttagcgatggcaaagtactgggccggttagccaatgcttatcggctattggcctcgccgactttgacttccgggaatgaaaagtttgcaccgatactggcagccttaaaagatgcacaagaaggcattgatccaatggtgattcgccgagttgctgacagtcagcgtcaagtcaatttttatcgcgggcttttgaagcgcatcggcgaagggcagcggcgattgaagcggatgaaatcacgaatcttttggcataatctgaaccatcttcaggagattctgctgacgccatacagtcgcttgtttgccagtaacactgccgatcgggagaatctgattcatactgagcaagaagtggcggcatataaagcgcagttaggggatctgaatcaggcattagcagaagtgacaacgctattagagcagttgcgcgacgaaaaagccgagcaggatcagctgatcaaacgccggacgcaatatgacgaacaaatcgcgacactccagggaaaactcgatgactatcaggcaactcaagccaagatcaagaagtatcaaaccaaattgaatgagctaatggcgcaacatgacgcgttaacgcagcaactaaacgcacatttacaaactcagttggcaccaattaaagtgcagttacttgcgcgcacgagtgaattaaatgatttctctaatgtgatgcaagctgatgcgtgggaagagatccagacccggctaagtcattaccttcatcagctgtcggccgccaaagtacaatatgatggccttgaagaaaccatgaatcgtctcagtgccgatatcgagatcaccaagcagatgcaaaccaagatgggcgatgcgatcgataatcgggtacaaggctttggcagtggccgagtgcatgatggtttgcaacaagacaaccaaacaattcacgaagccggtgcggcgcaaatgaataagcagtatcagccgctgcttgatcaacaaacggccattttggcaaagcatccggacctaaaagtgatactaaagaatgcgaccattttgccgcagctgacggcgattcaaaagcagctcaaaccgctgattaaaacgttaagtaagttgcagactgaactgcgcgcaaatgaaggacagcaatccgcgcaaaaagccaccttagacgcattaaacggaacgatcgatcctgaatttgatgccgcgggtttgcaagcaacgattacacgattgaaggcagagcgggctacgctgaaagttgatcccgacttacctaaacgtttgtcggcgactgctaccaaacaacagaaactgaatcaacaagtccaaagtgttgaatcggaaatcaatcagcgtcaagggacgatccatgttttaaccgcaaacatcaaaagcgccaccactcgccttgaagaatgggccgcggatggtgcttcgaagttgaagacgttaaaaccgtattttcccgaagacgttcggcttaaggatattgatgaattactggcttttgcgcatagtaaccgcagtcgcattcgcagcagtagttatgcagatatcagcgatcagatcgggcgcctgattcatcgccatgatggtcaaggggaagatcgaaacgcgctggatgtgctgtttgccgagcggggatttccagccgaggcaagcgctatgcggcagcaacgttcgattcctagcaacggcttgacggtggtggcatttgatatcaacgatgccatgcgtcttttgcgtgaagattacgctggcgttgaaaaagcgttagccgaagaaaaaagcggtaatgatatggcttataccacctttgtgcaagcagccgttgcagccattagtgctcagtatcatgtcatgacgacttagaatgaaatcctcgctcaaggcgccagtcatcagcacatcaagttgaaggtacgactcagcccagttgaaggcatcgccccggaagccattaccgaagcctgcgactctcagcggcaacagcggccacatttggaatcgttggttaaacagcgacttgaacagctggccaacaatactgaagtctccgacgatgatgatgctttctttgcagcagctgaaaacttacttgatacgcgtacatggtcagattttcaggtgttgattcggcgccgtcaaagtggtgaaaacgacttcgaagtggtggacgacaaattcgttcaatccggtggctccggcgcggaaaaggcgcaagcgatggtcttgccattgcttctagtgcccaagatggtgttacagcggtcaaaaatgcgtgacgccccgcatttggtgatgtttgatgagtttgcagataagttagatcctgaaaccgcaaaatcctttgcgaagaccattgtcaactttggtttcagttttattgcgactatgccaagcggggctcagaacaagcttttggccgatggggtggataatattgtctgggatgtcatgggctcgccacaacaaggcgatgggaagtttcatcttaatcgggtgcagcagaactttatttggaagaaggatacctgattccagattgatagggctattgccgagcgaggtaaaagcaagccaatactgaagtcatcactgtttttgagaataaattgacgtcatatcaatctgtagcctataatataggtgttgaaaagaggccaccggggggcctcccgatgacctcaacgcgtttcagatgacgaggggaaaagctagccgttttggttagcttttttgattatcgcgtacgctttcgcaatactggtaatcagtatgcttagcgcgatgataatcgacgccacatccaatgcggcgaccccctttcgtctcctgaacttggcatggccatcacctccgcgtttccagaatattgaggggtgtgagccatccaatccgctaggcaaagaagaaagggtaattggtcctttctcgatgcttggttatagtttatagatgttgaaataagaggtcaatcagtaaatcttttggcacaaaaaaggcttaaatacatacaacaacacagccgcaacctgcccaaagcaagataggtgttaccaaacaactttccaacaattgtttttcaaacgctgactgaaaaccggttttatcaaggaaaaaattttggtcagtgcgaaatgtatgaaggggtgacaaagtgagtcaatatattgaggcatttgaaaaggcaacgggacaatcagcgccagaccgggcagctaaacttgacgagttgtttaaccaaattaaacgcggtaaagccttgccgccgcggggacagcaggcagtcgccatgggactcacagcgcatacactcaacgatgctcgtgaagatccggcgctgtttgcctactatcggtgggtcatgacgcactgctttcagtctggacaggtcaatgaactaacagcgcggttgatcggcatggcgttcacgtctgcaaatgtttttgaaaccgacttaccccaacccttgacgttgaatccttggcaactcacaccgatgctcgactttccgttgaaaaacaaacaggcggtggtcatcgaaaataacggtgtgtttgcgttgcttcatcaggaacatccggactggccattgattttacagtccggcaatgacttcaatgacgtgtatgtgcgactcattcaaggactggaagaacgagggatgcgttatgcatatttaggcgacattgatagtgctggtatccgcatggccgaccgatttgccagtcttttgaagcaaacgtcagctgaggaggtagcagcattacagacgccaactgatgttcgagtatggttagcagatctagggaaaaagaatgcgaaacgtactaaacagctcaatgtgatgacgcgcgtgtatcaggatgagatgacaacgattgcactgtttggcaagttcattgagcaagaacagttggtgacgatttatgaaaagcggattgccgcatggcttaaggtgggaaaatagctggatacttgtgtggctacattttaaagaaaaaaattatctttcacaaaacaagtttgaccaatagaaaagggccgagttgtcacaagatcggtccttttgcaatgcctattttatacaaaaacgggcacagccaagtatatagtttgtgttaacaatgattgaaatgtttggagagatgaaactttgtgtgttgctgtagttcagcactgaggaggctttaggttctcatcgaccagtctctaagaaaagtcacgtgtggccaaatctctcactgaataattagagctattcatcaactgaaccttgatcgagctcaaagtcttctgaacagcggtggaagattcgtgaatttgaacaacaagatttctttttactacgttatttgtatcagaaacaagcctttgaagctggccaagagcaatttcggaatattggggatcatcggaaaggtccactagtgactgagaaatatttgtgagtaatttgttctcactgtctcttgagttgtgggtaatcaagaattgcaaaatttgcggtaaggtgttcctgagtttcgatctgcgaagagccaatggaacaaaattgactaataattcagaaacaaaaagaagatatcgcgggctggtgtcaagagtaagtgtcaaaagtaattttccagtgtctactcctaaaactgatatatcaacaaatgaacggatggcatcaattaaggatgtgggtgtgcttatctcaaagaaacctgaaggctcggcggtaatcttactggttcgaattttatcacttgtcttttcaaagtctttatagctatcattcgactgtgaaagcagagtcataagcagttcagttgccgactgctttgtactaataacttggtgaggattgttgagtgtgtcgacaatctgttcaaagacttgcccagtcatttggggattcagtcccgcatgcttttttattgaaatatttaatgtggcgaaggggtctgttgcgaacccgaaagttaatttaccatcttgcttatcgttttgtgatttcatttcggaaagttgatcttccaaaaaatcgttgtaaccagcatcttcctgattgttccaaatgaaaggagcaatttcgtgattgaagaacgtctcgtggtttttgatgaggaatttttttagctcccttgattcatttggccaagcagacaaaactgacaggattgcgagtcggattttgcctgtgaagcgtgtttgatccgaattttttacgatggtgaagagaactgcgatgacccgatgctgctgatcaatttgagcagcggtataatctattgcgccaaatatgatgtctgccaactcttcatagtagtgcttcaatgaaggaactaaagcttccaaaatagcgataatatcattttgcggaattctaaaactatttcgtaatagacccaaaatgtcagtgggagattgcctaatggaaacctttcgagtcgcccatacttttatttttttgtaaagaattgtccaagtatcattgaagcttttgtctgagagatagtcaccaacgaggcgtagtgaacttgcttctacacttagcttttcggcgtctacagggtatgattgggatgatttgataagagaaagtgcgtcctcttcagaaaattgtcccactagatagttataatgcgagatccagggggccatacccttataggaatctcccataagtagtttattttgtaacaagtcttgtaaatactctacattttgatatttccgcaatagcatttcagaaataatattgagattctttggtagttgccgaatctgtgtaattgatccgttgcatgcagcgactacaaatgcgtcagtgagtaaatctggatacactgcgataccagggccatatgaactttcctgtgtagaagaagcagttaaagttttgttctcttcttcccttacccaagaatagacgcgctcaagtgagtggtcaattcctgggtaaaagaaaggtttcgggaattcttcaagttgtttttaatatgggttttcgtcattcggcggattcttttcttcgacttcgatatttagtaagttgcggagggtcgatgagggtgtcttgtaacatccatgtggggacttcgttgatctctgcattccttagtagttctttgagcgtctttgaagcctcttttggtttagatgagaagaataagtagactgcttttaacttggcagtaagcactttctttaagggctcaggcaaagttgttttagggtttgcggactgaattcccaaaaacattaatttgtcccagttaaaaggtaacctcttgttgtagaaaatccgtaaaatcagattactaacgctttcatcaataggggagtctgccgcatctcgtttccttccaagggtatcgtgaaaaactcgggttcgaatcatctctttagaaagccctatctttttgaacatcgttttttcaaaaagaaatgatgtgtcagggacaaatgattcatcagaagaattgatcgtattgagttgttcttcgttaaaaataggggagttcttattgaaaaaagccttaaaagttgtaaccatctgattgaaaagaatgttctcaatctcgtcaaggtaatcttcacttcttggaagcacctgcacccagttgttttccccctgcgccagtaactgctgttgcatttttgaacctttgtcattcttggatggaagtatacaaaagagccttgggatttggtgatttctagctgccgtaatctctatctgcacaccggctggtatcggatactcagaatctaaaagtacaatcacaaggttggagtccacaagttgagttagatattcagtctctggttccagaattgaggaaatatcttgttctagaataaatggttcgatgaactggtatttagttaatcgatcatttagagaagtccgtaattcaagaatcctctttctctccggtttatcgggatttttcatggctgagctaataaatatacgaagtggacgcaatttctcttttctcattattctatcctttggcaggctacattatcattctatcgttggatttttaattgtatctatactgttaatgatcaatattcgatttttcctctatatcttatctaaatgcgagtttacgtattgtcaatggagacgttgaacatcggccaaggtatcttttgtctgaccagcatacatataaataatgttatccagaataagtacgctttttcggatttttgccggaatcgtcaacgatttcgtctttgtgaaaatattttgcacgagtttgatttaatcaatcaggtaattaattgaactcaggcttttcttttaactgttattgttataattagaggctattaaaccttgacttgctttgagccctttaaacgcgtttttaaaaatgcataatcgtatcttaagatggagtaaacgatcagcactcctcccgagacacacgtttgttcggtcttaccaattcttatctgcaaagaactttgagttatcttttgatcttttctcaatcgcctgaccttcatgcccaccttgatctcgattgctttttcttcgttcacatcgatctttaatttcacccgtctgaaaactgtaataatctcagcagctctttgcaatatagacttttggtcttattgatgataattgaaacattgatagtgtttctcgtcaagcataacaagtttagtctgaaaatcggctggaaattcaataaaaataataattttttgatttttcacgaatcttaaaactcaccatacattcgacaagttgtcttggcttgtatggcgccaattaaaaaccgccgcgcgtaaacccgactgttttatctcgctcactgggttgctataatgatatttgctgagtaactagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaactaagcagactgaacagaaattgtggggaagatattttgattgaagaccaaaccattcaaatcgtacaacaagacttgacgggaatgacgagccggcaaatcagtacggttttgaatttgatgaatgaaggcaatacggttccgtttattgcgcggtatcgtaaagaaatgaccgggagtctggatgaagttcagattcaggcgattgaggaagcctataaacgggtgacggcgctgcaggatcgtaaagctgcggtgatcaagagtattgccgaacaaggggcgctgatgcctgagctggagcagcaaatccgtgctagtaccaagttgcaggatgttgaggatatttatttaccttataagcagaagcgtcagaccaaggcaaccattgctaaagcgcgcggacttgaaccttttgcgcagtggattctttctttcccagtaggcgatttgacgtctgaagcggctaaatttgtgaatccggacaaagaggttgcgactgagcaggacgtattggacggtgcccatgaaattcttgcggagaagtttagcgaaatggcgccgatccgcaattgggtgcgcaatttcaccatgcgtaccggtacgattaaaacgaccgtcaaaaccaaaggcaaggaactggacgaaaaaggcgtttatcagcaattttacgactttgaagagaccgttaagaaaatgtcatcgactcggacgctggccattaatcgcggcgaaaaagagaagattttgacagttaaggttcaagttgaccccgcttcggtgatgcagtattgccattttaaattgattgataatcgcccaagtaccgaagcaacagcgtttattgaagcggcatatcaggatgcctacagacgcttcattggcccggcgattgaacgggaagtgcgcaatactttaaccgaaagtgctgaggagcagtcgattaaagtctttggtcagaatctgtacaacttgctgatgcaggcaccgattaaaggcaaggtggttctcggatttgatccggcttaccgcaccggctgcaagctagccgtggtggacgaaaatggtaagtttttggacaaagctgtcatttatccgcacaaaccggcgccagagaagaagcgtcaggccgcggcttcggaactgattgcgctactcgaaaaatatcatgtgacgatgattgcgatcggcaacggaacagcaggtcgggaatcggaacaatttgtggcggaaacgctcaagcagattaagcgggatatttattatgtcatcgtcaacgaagctggggcatcggtatattcagccagtcaagaggcgcgggatgagttcccggacctgcatgtcgaacagcgcagcgcaatcagcattgctcgccgcctgcaggatccactggcggaattagtgaagattgatccggaatcgattggtgtggggcagtatcagcacgatttacccgccaaggcgctggcaagtgaagtcgatgcagtcgtggaacgcgcggtcaatcaggttggcgttaacctgaacacagctagttaccaactgttaacccacatttccggattgtcaaaaacgattgcgactaacattgtgaaataccgcgatgaaaatggccgctataacagccgtgccgaattgaaaaaagtgccgcggctggggccaaaatcatttgaacagtcagttggttttctgcgaatcattggcggtaagcagccacttgataacaccgatattcacccggaaagttaccctgttgccaaaaagattctggctgcggcggggttatccacggctgatttaggtgatcatgaagtaattgccaaggttgctagtgttgatgtggccccatttgtcaacgatggtgttggcgttgagacagtgcatgacatcattagcagcctgcaaaatcccggtcgcgatcttcgtgagaacatggcagcaccgcttcttcggcaagatgtcctcaccatggaagacctgaagccgggcatgaagctggaaggaactgtccgcaatgttgtagatttcggcgcgtttgtcgacattggcgttaagcacgacggtttagttcatgtctctaaaatgacccgcaagtttgtccgcgatcctaaaacggttgtggcagtcggtgatattgtgacggtctggattgaatcggtggatctcaatcgcgagcggatacagctgacgatgatcgcgccgactgttggttaagcgtaaagacagttacaggtttaattatcgtaaaaaggcgttgccgttagatgctgggtattaaccaatatctaacagcaacgcctttttctaatggaacttgaattgtcgcaccggcaatggaagtacacttaaaaaattctaagacttacttttgcaaaaaactttgccgccattcgtttaattccgcagaatgcaagggcaaccggccatcatgatgacggagcggccagtaacgagggtcatcatagttcgtttttttgactgggatttcgcgttgcacccattcataaataggcttagtgttcacgcgtttctgcagccgattgattaaatcatcaagtaaatgaacccgctcgtaggcccaaattaatttcagcggctgggcagcctcgtgtaaatcatatctggcggcataatctgaaatgttccacgattcataaactcgccgatagcgattacttttaccgctaagtagatcgtcaagttcaccgcgctttatttttgctcgtaagctacgattggtgcgctgcttcattccttgatgccagtctttgacaacgggatattttttgaaacttcgactcatgatatgagcactcctttcagggtactcacaaatcgtggatgcgtttcataatgtcatctcctcaaacgttttcttgcaaatattgtactgaaatttaggcttaatgtcatttgtaagggtcgactttgatgtaaaattgcggttttgcgttcattttatgaaatcggtttccttcattggtggcagtctatcaaggattctgagacgtaaccgtatattaaaataatggttgaaattaattatagaaagattaaaatattagaatatctaaaaaaggagctgacagtatgcgaccaatcatcgcacttaccggagattcaatggtcgcgccttcgcctgtcattaatctgaactatgcagacatggcgccaaacatgatcaaaaatgcaattgtaaaagttggcggggcaccgttaattttgccgtatcctgaagatgacgctgcagcagcgtcgttggcagcacaatatgttgatgtttttgacggtttggttttgccaggcggaccggatgttgatccgacgttttatcaagaagaacccattcaagcgatggggcgggctacttatcaaaaggatcggttcgaaattgccttaattaaagcaactttgaaggcgaataaaccgatttttgcgatttgtcggggcattcagattcttaacgtggcattaggtggcaacctttatcaggatttgccaagccaaaacccgcaagccaccattcgccatgcccaagctgcaccgggacagtggccgacccatcacgttgcgattacgccgggctcccatttagcagcattgttagggacgagtagttatgttaactcccggcaccatcaggcagttaaggatgttgcagcgagtcttaaagtcactgccaaagcgccggatggagtcgttgaagccgttgaaagcaaggagtcgaatctgattctcggcgttcagtggcatccggaaaatatgtggcaacaatttccggaacaactaccattatttgccgatattgttaaacgtgcaggaggtgatggcaatgaataatgttgtgaagaaagaaaaaatgggttattggagcatgattttgctggggatcaacggcattatcggttccggaatttttctgttacccaatcaggctgctaagttaattgggtcagctagtatttttgtcttactttttgatgctttgttggtcatcagtattgcactttgttttgctcaagccgcgacctattttgatcgtgatggtggtccgtacttatatgccaaagatgcatttggcgattttgtcggctttgaggtcggctttgtcacttgggcgattcggattatcgcggaggccacgatggcggttgcttttacaactgcattagtcgggacttttccagcgttaaaccagcctattattcgcgattcgattatttcaatcatggtcatcggcttggcgctcatgaatatcgccggtgtccgggtttcaaccgtggtcaacaatgtgattagcgtttcaaaattggttccgctagttttgtttgttgcaattggcattttcttcatcaaaggcagcaatttcacgccattattcccaggcggcagctataagtccggtagtttcgggcaagccgcggtggtcatgttttatgctttcaccggttttgaaggcttagtcgttgcggcgggcgacatgaaaaatgccaagcgtaatttacccaaagccgttgctaccgtcatgacggtggttgcacttttttacatcctgattcaggttgtcagcaccggtattttgggaaacgcgttggcaagtacagatacaccaattcaaaccgctttcgctaaaatcaccggtggctttggcaatgctttggtggccgccgggacgctgttatcgactgggggactgcttgttgccagttcctttatcaccccgcggtctggagttgccctcgccgaaaatcacatgatgccgcaattgttggccaaacgtaatcgggtcaactcaccatatgttgcgatcatcgtgtccgcaaccattaccttactcattgcgtattccggcacattcggctacctcgctcaaatcagcgcggtttcaagatttgcccaatacattccaacatgtttggcggtgatcgtgtttgccaaaaccaagaccaaggataaaagcagtaccttccatctgccgcttggccccgtcattcctgcagtagcaattttagtcagcatctggctattggttcaggttcaggtaagtcagctggtcattggccttggcgcgttgctcgtggcggtaccgttttatttcttgacatacacgtaccggcagcatgggaaagcatgaagtttggaaaataaaatatattataaaaaccagttcaactgttatcggtagtcgaactgttttttgctttgaataggttacatttgaaaattgaaccaagcgtttaattaggttggacgttccgcttaatccaggagccgaacacctaacattccttttttatttactttagccgtatacgcaaggtgataaaccgcatcaccccgcagcatagcttcttgtatctgtttaagctctgcttcagctgcatgtctggtttgataccaaccaagctcaatgaggcgagtggtgccaagcaacccgcgctgactgctctcaccgattagaagaaaagtgggcgcggttttgctaggaataccttcagcaatttgaaaaccggtatagttgcctaaacggtcattgattagggaagttattgtgatggcgctacttggcctgttagcagctggtttcggttctggtggttcattaccaagcagatcagcgtaagagactcctagaatcatcgtgaactgctgaattttttgaaggtccggttcagccaagttgttttcgtactttgagattgcctgccgactaattcccatggcttcagctagttcattttgcgaaagtccactccttttgcgcaattgcatgagtcgttcaccgaacatcgtcatcgcctccttctatacctcaattatccgatagatgcttgacctatacaagcaatcaagggttgcgaagtgtcaactgggggttgcagaagggtgtaatcagtctgaatctttaaagttgtcttcgtttttcgctaaattgaaaagtggtagggaaaattttcgaactagattctcgtcatcaatgacggttgaagtatctcgattgtaataggggctattctcatccctgacggctgaaaaccaattaaaagagccgtttgccagaatatggccatctactacaacctgttttgagtgaactcgagacgaggcctcaaaaatgcttgcgccagatgctttcagcaatgcgataccgccttcaaagtttgccatcttttggttatctgtttgatcatacatggcgcgatttggatagatgttgacacgtacacctcggcgagtagcttgtttaatagcgctaagaagtgcgattgtgccagcctcaattgacctttttgatatataaggtgagctaatgtcaatttgcttttttgcggttaaaagttgatggtacagccatttgtcatgtgtcttggcgtcactaagaacgaactggcgatttgatttgatctcttcttcagtaaaaagcgttacatctttaatttcgttgctcgattcagaaaatagtcttcgggctaattgtgaagatggcttattgcccttagtggtaagtaaatcgatattgccgaaatataagaagctatcttttgctcgtgataccgcgacgttcagcatattgatgcccttatcaaagaaaaattcagtctttgcgttgtcataaacaggtgaaaatagaactactctccgttctgcaccttgcatcgcatgaaccgttccgacaatgattttttgatcatctaattcatatcgggttaaggcttcattgatttctttggcttgtcgattgaatggtgataatattgcaactgtatctccaagtttccaatccttaacattttttccttccaagttacgaaggcttgctttccgatttttaagccattgagcaatggcatcggcttctcgacggttgtaacggctgccattttggatagccgacagtccgaatacatgcgcatagcccagttgtggcagctggtctgacgaggtgatagtagggttagaacgtttaggaattagtttaccttgataagctagtgtattgaagtaatcagtaattttgggtaaacaacgaaaatgttcttgtagtaaaagaccgccaccgactatttcgctctgtgtaaacacactttgatgttgtgccacactcataaggttgcccgaggatgttgcaaatcccgtctttttgatagcagctatttcatcttctgaaaatttggtcagacttcgcatgttggcttcgtcaacggatttctggacgctccatatcggttcaatttgcttaacgtcgccaactgccagaaaacgttttgcaagtgcgagacttgcaattgccagttcaggactaacttgaccagcctcatcggcaatcaacaaatcaatgccattaaggaagggaacatgatcttttcggaaaaaggcgtctacctgataaaaggtgccaacaaaacaaggtgtcagcattgcgcgaacttgccaaactttccgtactttttcaaatgcggcggttgctgagttagtttgatgctgcttcatttctgttaaccagcgagcctcccaataatgggtagctagcaagaacgctaagtaacgtaaatttgtatccacttgcttattaagatctgaacgtgattgcgtatttgttgatgtcaatttgatgttattctgagcgcaggctatcttaaaattctcttgacgtttctgaacatcaattagagccagttttgtagtgtttatagtcttacttaaagcagtattttcagctcgaacatgatcaaggtttcgttgaagatcggtatcatctgaaaaacccttcaagtgcaaataatcaatttttcttgcggcttttcttttaggaccaatcaacggaaaataatcaagaatgcttgcatgtttagcgtcaaagtcataccaaccacgaagctgcctttcagcttcgtcaacacttgcctggcttttggttaattggattgtttgctcggaaagtgttgcggaaagtgttgctgcctgtttgtcgaaattaacgtcctgaccattgataatggttcgaatgtcttctacaacgttggttagataaccatgaagcgtttcacgacatttttgaagtgagccacctgaatccggaaaaagtgcatgataattttgaaaaaatacttttgtagccttgcttagcgcgtcatcagtaattagctggtcaaagtattcgttatgattgatggaaatcgcagcatatggaagtgtcccgtccgtcaagtttctatttgctgcaagatataaaccataggtgttatgtccaggtagccaatgtgaaataagtgttgactttttcactgacattttttgataaatagcctttttgggaagtgaaaatgccgcaacctcttcatcatttagttcaccagcttgaaagctttgaataatatttgtaacggcttggttgttaacagatgaagcgacacaaatgggaggcatggtctctttaaacgccgcttgaacccattgcgtggccacaacactttgaatcaaagtcgtcttacccgtgcctgggggaccgctgacagccaatgtttgtccgttagttgtagcatcaaggttggccaatgcatttcgttgggtatccgtcatgccatgcttgggactcatttgagcgaggtgattagagtaatgagatctcatgctagcttgggatagaatcttttcatcttgaacgctggattcaggatttaaagaatcgaaaagaggaagttgctctttagaggccagaatgtcttgataaaggccttggatttgagctgaaaatcctaaattttgctcgccaggaatgatatggcagatacctgttggttcggcaggtaggacataattgttcactttttctattgatttaaatgtggcaaatgacaagttggtcaagtgttgaaagagagcctctgcttgatgaatgtaatcagaccactctaaatgatcaagagcaccaccattgattgcatcaaaatagtcgttgacatttgcaattggtttatagcgtagtggatgggaggaatcttcgccagctggggtcattaattcacgttgaatccacggaaccgtatattcctgatgagttagttgaccatcttcatttaacattgctggaataatgaaaggataaatgaagaccttcgcagttttgatcacaatcggcataatgaaaacacttaagccgtttgacgactcggtttttgcaaggcccttccgcgtacgtttgaaaaaatctggaaatgtagggctcaaaattttgccctcaacaatttcgctatagttggtcgaaaagggtttagtatacttggcgttaacctcgacaagactgctttgacgcaaactttgtagatagtagttggcaatttctttggttgaaatcatattaagtcctccaaattggtataggcgttattaggctatctacctatacaaaagcttggctaccgttagtatacatttttgggggaaataagatagaaaattgtctgcaaattctgtgcaaagtctgtaaacagttcaagagctcaaacaaaaacagccaactccgcaaagagttgactgtagctgtgaagtattaaagtttctggttatagtattcaacaaccagtgattcgtcaacttctggttcgagttcgccacgttctggcaagcgaacaagggaaccttccttcttattgtcgtcaaaggttacgtaagctggacgggaaactgtgttctcgatagcttcattgacaacagcgaggttttgtgagcgttcgcgaagaccgatcacttggccaggctgtacttcataggaaggaatatcaaggcgcttgccatcaactgtgatgtggccgtggttgacaagttggcgcgcttgcggacggctggaagccaagcccaaacggaaaaccaagttatctaaacgggtttcaagcaggatcatgaagttatcaccatgggtaccttctttgatcttaccagcgcgcaggaacaagttctggaattggcgttcgtttaaaccgtacatccaacgcagcttctgcttttcacgcagttgctgaccgtattcggaaatcttacggcggttgttggcaccgtgatcaccgggtgcataaggacgacgagctaattctttaccagtgccggaaagggacaagccgagacgacggctttgcttccagcgaggacctgtataacgagacatatgagtattcctccaagtttttatttggagtaaaataacgaattgcggctttagcacacgggcagtcctgcaaaggttcaccttcgcagccgcggttactactgtcatcggcgtgatgccgaggcaggactggagccgaccatgccggccgctgctgcattattttacacgcgagctagtataccgtgtttagcgcagcggtgtcaaggtgattggcgagcgtttgaccgaactgtgtcaggatctgttcgtcgttttcgctaaaacggttgagtttcggggagtcaatgtccatgatggcaacggtttcgccattaacgttgatcggcacgacgatttcggcgttgctggctgaatcgcaggcgatgtgaccggcaaattcatggacgttagcaacgcgaatcacgctattttgccgatagctggttccaacgacgcctttgcccggttgaatgtgcatgcaggcaacttttccttggaaggggccgaggtcgagctgcccggttttgccattataaaggtagaaaccagcccagttgagctcaggcatgctgtcatttagcagtgcactggcattggcaagtacggtgatggggttggtttcgcctgtaagtaggccatcaagttgatcgataataataggatcaagggttgtcatttgatcagtccttttaggaatttatgaaaagcagcatctaggccttttaactgcgggctttttttgcgatactggtagctaggatgttatcgtttttaacacttaacggcattttagccggtaagtaggcaaaatgcaattagaaagataatcggtaaagcagagggtgtagggatgatctggttcttcattattgttgcgattataattgtggctgctggcagtgtctggtggctgcagcattattttcaaacgcgtatcaaagacttagacgaaaaagtcgaagcgattgatattggtgcgctctcgagtcagattcgcagcattgagcaactgaagctgaccggtgacagtctggcaacctttggcaagtgggagcgggcgtttgatcagttaaacgaccacgatctagctgagctgcaaaagattctgcttgatctcgaagaccaggttaaacgcttccgtttagatcgggcatcgaaaattgcgaaggtgctggaagataaaatcgagacggctcagcgccaatacgaactgattagccaggcactacaagacattcggcacgacgaagcagataaccgtagtaaaatgttgcaattgcgagatgattaccaggtttcacgcaagacgattcttgccaagagctttgtcttcggtgatgctcagccagcattagagcaacaattgcagcaattggcgcagctttttcaaaaaattgaccagatcaataatgatggcgatcatcaggcggcaaaggcagaaattaaacagttagccgagcagatgcgggttttgaagaagcaggttaaggaattaccaccactggtaaacgagcaggtcaacgagtttcctggacaaattaacgaaattcagcacggttaccggcaactcaccaccgcccattatgtgttcaccgatgatattccggggatggttgcggatgtcgaggccaagatgaaggatgccaatgcggctcttaaatcgattgatgtggaggcaacagaggcagccaatgcggaaatcgaagctgagatcgataaaatgtacgccattatggaaaaagagatgcaggccaagaaacgggtggatgttgcgtcccctgatttgcggcgcttcattgatcatgcactgcgccaaaatcgggaattgcaggcagaattggatcatctgaatcaaagctacacgctgaatcatcatgaaatcaaaaccgctaaaaatttaaaaatgcagttagatgcgattgacgcaaattacacgaaggataccgatgcgattgaagcaggcgaggccgtgtactcggacgtgattgcgcggtttgatgaaaccaaagaacagttaacggcgattgaaaagcaacaggtccagattaaccaagacgtggcaggtttgaaaaaaggcgagatcatcgctaataaacaagcagagagttttgaactcgatatgcggaatattaagcatgaaatcgtccgccatcacttgccggggttgccgcaagactatgtgaataaggttaaacatgttactgccgaaattgatcagcttaatcacgatttggatcaggttaaaattaacatggatgcgattgccaagtttctgattaagattgccagtgatattgatgatttaaagaaaacaaccagtgccttaattgatgcggccggattaaccgaagaattgatgcaatatgccaaccgctacaaaataacggttaagccggtggcggacgcggttaagcatgcgaccgagctgtatatgcaatttgactatcagcaggctgccgatacgttggcgaccgcgttggagcagacggagcagggcagctacaagaaagttgaagatgcttatcttgcgcggaagaaagcttcattatattaatttgcgtgattggaaagccagccggggtttgggctggcttttggtttggggtggaggttgtgatgtgtgcagggatctgtaggggggaattgcagacttaaatgggcaataatcattcagtagggtatacgtctccgaaacgcgttcaccggcgcagagatctgcgtgtaaggacctcgaacctaaatggccaaagcccagccatttaggttcgaggccacttacactccgatctctaaccgcgccggttcacgctcttgaaacttactaactttttgtctataattcaatccagtcgaattaacggaaggggccggctgatgatttattttgataatagtgcaacgacgaagatttcgcctgatgcgttggcgacttataacaaggtcagcacggatttttttggtaatcccagcagtttgcatgctctgggaactaaagcaaatgaggttttgcagagttcgcgagcccagattgctaaattaatcggtgctaagccggacgagatttattttacgagcggtggaactgaaggcgataactgggtgattaaaggcactgccatggctaagcgcgaatttggccgtcatctgattacgaccagtatcgagcatccggctgtgatcaatacgatgaaacagctagagaaactgggatttgaagtgacttatttgccggttgatcggcgcggttttattcatattgacgatttgaaagcggctattcgcaaagatacgattttggtgtcgattatggcggttaataatgaaattggcagtatgcagccgattgttcaggccgcgcgggtgttggataattatccgaatattcattttcatgttgatgctgtacaagccgttggtaagggcttggatgcagcgttgcaggatccgcggattgattttctcagtttttccggccataagtttcatgctccccgcggtaccggctttatctatgccaaagagggtcgcatgcttgatccgttgctaaccggtggcggtcaggaacatgattggcgctcaggcacggaaaatgttccggcgattgcggcaatggccaagtcgctgcgcttacttttggctaatgaagatgctaacgtggctcggcagcaagcagttcgcaagcggatttttgaacatgtcagccaaaagcccaaggtgacgatgtttagtcagttaacaccggattttgccccacatgttttatgttttgccattgctggtgtccgcggcgaaacgattgttcatgcgtttgaggatcatcagatttacatttccacaaccagtgcctgctcaagtaagaaaggcacggaaagcagtaccttggccgccatgcatacggacccgaaaattgccacttccgcgattcgggtgagtttggatgaatctaatactttggatgaagcggatgcgtttaatgcagcgtttgatacgatttatgcaaagtttgccaagcttgataaagcgaccgtctaaacgagcatcagccattgccagtgcgaggagtggcagggtgtcagttatagcggctgatactgccaacttgtttttacgcatcaccggtttttactggatcgggtaccgcctacatgaaaggattttaagatgcaatattcagaaattatggttcgttacggcgagctttcgaccaaggggaaaaatcggcaagcgtttatcggtcgtttgaacggtaacgttacacaagcgctgcatgaattccccaatctcaccattcggcctaaacgtgatcggatgcacattgaattgaatggcgagcctagtgatcaggtgatggcacgactgtcacaggtattcggcatccagaatttttcaccaagtattgccgtagaaaaggatatggcaaaagtccacgaggttgcgttgcagctgatgaatgaaacggcaccgcacggcattagctataaggttaatacgcggcggagcgatcatgactttgccttggataccaatgctgtgaatcttgatttaggcgatttcttgacggataagcggccggacttagttgtcaagatgcatcatcctgatatgattttgcgagttgaagtccgccgtgaagcgatttatttatctactaaaacgattcaaggcgctggcggattgccggttggaacagcagggcgcgcggccttgatgcttagtggcgggattgattcgccggtcgcaggctactatgcgttaaaacgtggcgtggacattgaaatggtgcactttttcagcccgccttatactagtcaacaggcgctgaataaagctaaacaactcacggccaagctgaccccttatgttggccggatttactttattgaagtgccatttaccgagattcaggaggctgtcaaagcaacggttccggaaggttatctgatgaccgtgcaacgccgaatgatgttgcgattgaccgaagcgatagccaaacaacgtggcgatctggctatctttaatggtgagtcagtcggccaggtggcttcacagacgctggaatcaatggcagcaatcaatgatgtcaccacgatgccgattattcgtccggttgcgaccatggataagaatgagattattgccgaggcagaaaagatcgacacgtatgatttatcgatcatgccgtttgaagactgttgtaccatttttgccccgccgtctcctaaaaccaaaccaaagacggatcgcgcacggtattacgaaagcaaacttgatgtcgatggtttgatggcgcgcgcgttggccgggatcaaggttcaggagatcaagtcatctgatcagttcctgaatcaggatcaggatgttatcgcagaattgctttaaaaattgaataaaagcggtagttgctgataagttatttgcttatcggtaactaccgcttttttagtttagcgttaaaagtcggcgaatgatcttaaaaaagaaataattcacaagatttcgcgatattaataagttgctggatcgaataccatcatggttgcccgaaaaatggttgtcacctgcagaagacgcattgtgcttaattcctggtttgaaaagatcgttaatataaaatggctcagtaaaaacagtggtaaaagagcgcgcaatttgttaaactaaatatgtgaaaatggtaacaaacacgtgcggaggtgttgatggtggtcgtcagtaaacaagcgttatcacaggcaacgattaagcgaatcccggtttattatcgaaccgtcaaagatttgcaacaggcgggggttaagcgggttcggtctgatcggctaagtaagctggttcatatcgcgccagcaaccattcggcgggatttttccaattttggcgatttagggcgtagcggctatggctattcggttgatttacttgcgcaggtgtttggcgagttattagaagtgcactcggaagaacagatgttactggtggggtgtggcaacctcggacgggcgttgttgaccaataattttcgccggaatccggatctaaccattgtgatgggattcgacacggatccgcagctcattgggacgacaattgccggggtgccgatttttgatctcacaactttagcccaaaatattcgcccggggatgcatactgccattgtctgtgtgccgagttccgcccagaccagcgttattaaccaacttgaggctaatggcataaccgctattttaacctttgcccctaagccggtcccggcaaaaccgacaaccacgattcgctacattgacctgacaagtgagctacaggcgttattgtttgttgatcatcaaaaacaggttgcgcgacaggtgacggagccgttgcgctagtgttgcttggtgagctggatcacgctcgttataacgtgtttacctgcccagaaacttgcatataaggaccttggcgcaaatccgtttttacgcccataacgcgctccccggcgcagggacctgcctgtaaggaccttggtcgcaagtccgcctttacgcccataacgcgttcaccggcgcagaagtctgcgtgtaaggaccttggacgcaatggccaagcccgggccatcacgaccaaggccacttacactccgacttctaaccgcgccggttcacgctcactcacattgaccctgtcatgatcacgggttataatgcagctaatgcaatgatcaagagggttgcggtcttttttttcagcgacgggatggttggtgtgaatctcgaaagaagggcgtgattgtagcttgtgagctgccgtcctgaagtgagtagggaacggccggtgacagccgttatcctgaaccaagtggggattgattcccaatttaggtggtaccgcgagtagactcgtcctaataatcgatattagggcgtttttttgtgtatacgcacggcgcgacccagctttcgggctggcgtgcgggtgatgcatcagcgcgtgccaattctagaaaccggatggacgaaaaaattttgtgaggtggagccagtgagtgatgaaacgttagcaccaaagtatgatcataaagcagtcgaagaaggccggtatcaagaatggcttgatgaagatgtcttcaaaccaagtggtgataagaaggctaagccgtattcaatcgtgattccgccgccgaatgtcaccggtaagttacacatggggcatgcatgggatacgacgcttcaagacatcgtgatccgccaaaagcgtatgcaggggtttgataccttgtggctgccagggatggatcatgccggaatcgccacgcaggctaaagttgaggccaagttgcgcaaagaaggcatcagccgctatgacctaggccgtgaaaagtttgtccaaaaagtctgggaatggaaggacgaatttgccaagaccattcatggacaatgggccaaaatgggcttgtcactggattatagtcgggaacgctttactttggataagggcctgaatcaagcggttcgacgggtgtttgttgacctttataaccaaggcttgatttatcgcggtgaatatatcgttaactgggatccgcaagcgcgcacggcactatcggatattgaagtcattcataaagacgataaaggtgctttttaccatgtgaaatatccgttcgcagacggtagcggctacattgagattgcaacgacgcgtccggaaaccatgatgggtgatactgcggtggcggttcacccaggtgatgagcggtataaagatatggtgggcaaggaacttattttgccattagccaatcgcaaaatcccgatcattgaagatgcttacgttgaccctgagtttgggactggggcggttaaaatcacgccagcccatgaccctaacgactttcaggtgggcaatcgtcatgatttgaaacgaattaacactatgaatgacgatggcacgatgaacgaaaatgccggcaaatatcaaggaatggatcgctttgaagcccgtaaagctatggtggccgatttggataaggccggtttgttgcttaaagttgaaccgattgtgcatagtgtcggccatagcgaacgtacgggcgttcaagttgaagcacggttgtcaacacaatggtttgtcaagatgaaaccattagctgaagcggcaatcaaagcgcagcaagagccggacaagaaagtgacatttgttcctgagcggtttgaacatacctacttgcagtggatggaaaatattcatgactgggttatttcgcggcagttgtggtggggccatcaaattccggcttggtacaacaagcagaccggtgagacctatgtcgggatggaagcgccaaaagacattgaaaactggaagcaggatcctgacgtgctggatacctggttttcaagtgcattgtggccattttccacgatggggtggccgaataccgatgcgccggattacaagcgttattacccaacagataccttagtgactggctacgatatcattccattctgggttgcgcggatgattttccaagggttgcattttactcatcaacggccgttccagtacaccttgattcacgggttaatgcgcgatgaacaaggccggaagatgagtaagtcactgggtaatgggattgacccaatggatgtgattgaaaaatacggcgccgatgccttgcggtggttcctgattactggtaataaaccgggacaggatacacggtttagttataaacaggttgaagcagcctggaatttcatcaataagatttggaacatttcccgatttgtgatgatgaacttaggcgacttggatacgccgcaacagccagatccaagtacctttgatttgtccgataagtggctttttgcgcaattgaacgaaaccattaaacaagtaacggatttgtcagcgcggtttgaatttggtgaaatgggtcgaaccctgtataacttcacctggaatgttttcgcggactggtacgttgaaatgagtaaggaagtactttacggcgatgatgagcaggccaaagcagccaagcgcgtcaaccttgcttatgcactggatcaaattttacggctattgcacccagtgatgccgtttgtgacggaaaaactatggttggcgttaccgcatacaggcaaatcaattgtgacggcgagctatccggtggcaaacgctgcctttgaaaatgctgacgctaccagtgcaatggatgcgatcattgcgctcatccgcggcgttcgcggtattcgtaaagaggccggcgctccgcttaagaccaaagtcgatattatcgttaaattgacggatcctgctttgaagccaatctttgaacagaactttgactttatcgatcgcttcgtcaatagtaaagccttcacggttggaaccgatgtggccgagcctaaaatggcgggcagtgcggtgatcacaggcgccaccattttcgtaccgctcaatgaattaattgatttggacgaggaaaaggccaaactgactaaagatgctaagaagcttgagcaagaaattgcccgaattgacaagaagctcaataaccaaggcttcttatccaaagcaccggaagcggttgttgcagaacaacgcactaagcgcagtgattttgaagatcagctaacgagcactaagcaacggttggaacaattacaacaagcttaagttaccaagtggctttaagcgattttatgatgaaaaaaccggtattagggttgagttttaagccctagtaccggcttttttgatggtcgtggttgaagcatgccgcaagcaagcaatctggcgcgcggccgtttgttcgatgggttctggcagcaataaaaacgtgaatttgactggctaagctcataagttgggcccatttttctggtatgatgaagctatatatcgcagcagtatgaaagctggctgcctaaatgataaaaataaggaaagttaacaatgaattacacagaaagcgttgcctatattcattcttttccgcgcttggccaagaccggtgaccatcggcggattttaacgttattacatgcactcggcaatccgcagcaacaagggcggtatattcacgtgactggtactaatggaaaaggctcagccgctaatgcgattgcacatgtccttgaggcaagcggtttgacagtcgggttatatacctcgccgtttatcatgcggtttaatgaacggatcatgattgaccatgaaccgattccggatgctgcgttagtcaaagcggttgcgtttgtcaggactgcactggaacggcttcagcagcaacaagctgattttaacgtgacggaatttgaattcattactgcgctggcgtattggtattttcgtcagcgtcaggttgatgttgcggtgattgaagtcggcattggcggctacacggattcgaccaatgtcatcacgccggttgtcagtgttttgaccgaggtggctttagatcaccagaagttgctggggcatacgattacggcaattgccacacataaggctggtattatcaaaccgggtattccggttgtaaccggtaacttggtgccggatgctgctgccgttgtcgcagccaaggttgcgacaacagggagtcaatggttgcgttttgaccgcgatttttcggttcctaaggctaagcttcacggttggggccaacggtttacttatgaagaccaagatggacgtattagcgatctggaggtgccgttggttggcgattaccagcaacgcaatatggcaattgcgattcaaacggcaaaagtgtatgccaagcagacaggatggcctttgacgccccagaatattcgccaagggcttgctgccagtcattggccagcccgactcgaaaagataagtgatacgcctttgatcgtcattgacggggcgcacaatccggatggcatcaatggtttggttacggcgctaaagcaacttttttcccaacccattactgttattgccggcatcttggcggataaagactatgcggcgatggcggataagctgaccgcggcattttccacggtttatctggttccggtgccagggacgccgcgcgccttgcctgaggctggttatgaggcgctgcacgaaggtcggttaaaggattcgtggcaggaagcattggcggcgagtcttaatgatgtgccggatcagccgattgtgatcaccggttcgctgtatttagcctcagctgttcgtcaaactttattagggggaaaatcatgaccgcaacagtcatctttgatcttgacgggacactggttaacactgaagcactttaccttaaaagtaatgttaaagccgcggcagtattgggactgcaccggacagaagcagattttcggccattagtcggatctgccggaccaagtgaagctaaaatcattgccgatttggttggggccgatcatgccgcatggttccagcaattttcaactcaggatgttttggaccagattcgcagcggtgccgattttgtcttacccggagttgacaaaacgttgcagatgcttgatcggatgggttatcgattagcgttggcaacaagtagtgccaaacattacgttgacgtggtgttggctgcaactggttgggtgaagcggtttgacccgattctgactggcagtgatgtgacggcacacaaacctgatccggaaatttatcacgtgatgaaaaccaagttgcctgagacaccagcgattgtcgttgaagatacgcatgtgggtgtggccgcagcagaaggggccgggctcccggtcgtcatgattccaggcatcggtcaagcgccggatcataaggcgaccgcgattttagctgcgatcacggatttgcctgactggctgcaaaatcatcctgcttttgcgtaatgtccataatgagtcttcagatgactcaaaatggcggccccatcagagaaggctgaagagcatgcagcgcctcactctgaaagcggcatgacggagggaaagacgatggcagatgcgactgaacaaccacgtgagcgtttattggcgcatggaccacaggcactgacggatgcggaattattgcaattgattgtgcgcgcaggcaaccagcactatccggtccaggaaattgtcagcgaggtgttgaccacttatccagcattacgaggcttagcagaaggtgatggtgattcactggaccatattcgcggactaggcgcggctaaacgggccagcattttggcgggtgtggagttaggacggcgggtcatgcgtcgtcaatcggttcgatatgggcagatcaaaaatagcgagcaactgggtaaaacgatggtgtcacgctttgccggagctaatcaggaatccatgttgattttatttttggatgtcaagaatcaaatcatcacagaacaaatcgtggcaattggaacggtggattcagccttagccgatccgcgggtggtgtttcgggaagcattaaaactaagcgccacgaatttgatcatggtgcacaatcatcccagcggtgatccttctccgagtcaggccgatcgtgatacaacaacgcgattccagctggcggcagcgttactcggcatgcacctgcttgaccacttgatcattgggcggcagtcgtattattcgtttgcgcgcgatgatccggaatttaattaatttgctaaaaagttgtaaggttttctgaaattggcgcaatgagggcaaaaacaggcggtttcacattttgtcacagaaaataatatgctataatgcatggagttaatacgaaatgagtcagcataaggagagaacgtcttgtttggatttggatcaaagaatatcgggatcgatcttggcaccgcaaataccttagtttacgtcgacggcaagggcattgtgttaaatgaaccctccgtggtcgcgaagaatacccagacggaagaagtcattgccgttggtgaagaagcccgcgacatgatcggtcgtaccccgaccaatatcgtggcgatccgaccaatgaaagatggggtcatcgctgactacgacacaactgcggccatgttaaaatacttcatgcaaaaagcattaggtaacggcagccacccgcaagtgatgatttgtgtgccaagcggcgtgacggaagttgaaaaacgggccgttattgacgctgcaaaagtcgcaggagcacgcgatgctttcgtcattgaagaaccttacgctgctgcaatcggtgccggtctgccggttatggacccgaccggtagtatggttgttgatattggcggcggcaccactgatgtcgcaacgatttcattaggcggtattgtttcgagtcgctcgattcgggtggctggtgacaagtttgatgaagccatcatcaatcatttacgccagaactttaatttgctcatcggcgaacgtacggctgaagccatgaagattcaaattggttcggcatcggttgaaaaggctgccgatatcgatgggatgaccgtgcgcggccgtgatttattgagcggcctgccaaagaccatcgatatttcggcaacggatattgcctcagctattcatgaaaacgtgcttgatatcatcacggcgattaaagaaacactagaggaaacctcaccagaaatcgctgccgatgtcattgatcatgggattgtgttgacaggcggcggtgcgcttttgaagcatttaccggatgtcatttccgatgagaccaaagtaccggtcttcattgcgcaggatccactagattgtgtggcaatcggcactggtgaatcgttgaagaatattgacgttttaaagaagcgttaacagcccataaatgaagatggtttgcgtgtggcaagaggctgggatgaaggatcctggcctcttttcgcgagtgtgacggaggaaccaatgcagaaattcttttccaacaaaaaattgatcgccctcatgatcgcattgctggtcagtcttggtctggtcgctggatcaatctatgcgagcaataatcgcaatacgccgccgtttattcagcggattgccaatgatgttgttggcatcggcgggcggttagtcgcgttgccgggagattttgcccgcaatggattagatgacatcaataatctcatggatacgtttcaggagaatcagcgcctcaagcaacagctggataatttagcgcagacaaaggtgcaggtacaaactttaaaacgcgaaaataagcagttgaagcaacagttgaaacttaacggtactttgacggattacgcgcagatcagtgctgctgtcattttacgaacaccaagtgactggcgcaacatggtcgttattaaccaaggaagtgccgccggggttaagaagggcatgccggttatggcaggttccgggttgattggccgtgtggttgaggtcaatcgaacgagttcaaaagttgagatgctatcaacagccaataaatccagtgaccggattgcggcggccgttgagactaaaggcgaaaaagaagttaacggcatcattaccggatatgacgaaaaaaccggtgatttgattctcggcgagctgaatacggataccgcgattaaaaaaggcgatgaggtggttaccagtggtttaggtggcatgacacctaaaggattactgattggcaaagtcgccagcgtcaagaaagatgactatgggctggccaacaccgtttatttggatcccgccgcaaatctaaacgatgtcaccgttgtaaccgtcatctcacgtacgatcaaaggtgactaacatgttaaacgaaaaacatttcacaggacattggtggatctttttactgctgcttttgttattattaattgatggcagcctagcatcagtgctggcacagtggatcatgcagccgaactttatggggacgccgcaattgaccttgttagggttagtcatggtgacgttgttggtgccgcaagaaaagtatataacctggattgcggcattgattgggttgttattcgacagtttctacacgggcattctagggattaatgcgttgctgtttgccttggtcatttatgtggttcgccagattcggccgtatatcccgcacacgccaatttttgttggtatggtttatattattgcgttgttgctctatggggttgccagttatgctgcgaatcattttattggctacggatccgccagtgttgttatgctgatagcgaatcatttagggccgggattaacggtcaatctcatcctttttgtgattgtctatggtccattacatcgattgttgatgaatttagcggaagaataatttggggtgataatgtggacagtgtggtcttaaaaggtcgaaatgatagtctggcgctgcaccttcaagatacagcggattttacgcagattatccagacactgaaaacattactaggcaaattgtacgaagaaacgccaaccggtgatgtcagctatcgtttggagacgggcaatcggcttttaacggaagagcagttggcgcaaattcaggctgtatttgaagattacccgcgcttttcaattaatggcatcacgagtgctgtggttgataaagcggtcgttgccgatatggtgacggctaaaatgacccatcgcatcggtggtgttgttcgatcagggcaaacaattgatgtcatgggcgatgtgctgtttttaggcgatttacatgccggtgcctcgctgtgtgcttctggcaatgtttttgtgatgggtaaggttagtggcgttatccaggcaggcagtcaaggagacacccgcgcagttgttgtgggtgacttgcaaggtgctagtcaagttcgaatcgccgatgtcatcgaaattgtcgctgaccattatgatccggttaaaccggttgcttatttgagcgaattacatacgatgacacataccaagttggctgaactagcaaatcttcggccgcgattatttaagcaaatggaggcaatgtagatggggacagcgttagtagtgacttccggtaaaggcggcgttggcaaaaccaccacttcggcaaatatcggcaccgcgttggctttacaaggcaagcgggtcgtcttgttggaccttgatattggactacgcaacttagacgttgtcatgggtttgtccaaccggattatttacgacattgtcgatgttgccactggccgcgcgaagctacaccaagcgttgatcaaggacaaacgatttgacgatttgctttatttactgccagcagcgcaaaatgcggaaaaagacgcgttagaacctgatcaggtcgttgagattgttgaacagttgcgaccggattttgattttattattttggactcgcctgctggaattgaacaagggtttcggaatgcgaccggggcggctgacggtgcgattgtggtcacgaccccggagatatcggcagtgagtgatgcggatcgggtcgtgggcttactggaacaacgtgatatgccgctcaaaccgcgactcattatcaaccgcattcgccaaaatatgttagctgatggccgctcgatggatattgacgagattaccagtcatctgggacttgatttactcggcatcattgttgacgatgatggggtgattgagagttcaaacaaaggtgaagcgattgtgatggatccggatgaccttgctagtaaaggctaccgtaatattgcccgccggttactaggtgatagcgtgccgttgatggacattcgtttgaaaaaacaaggcttttggtcaaaattgttccatcgccatcattagacggtttacggtgattttgtgccggctgttaaagattaattttctgaaacagttgactttcgttaaagttcggtgtaatttagtgacaattcattaaagcgttgagtggaatcgataagcggtcatggttcacagcgagttcgggttgatggaaaccgaatagccatccgtttatcacacatccatgagtggacgattgaacaacagtaggtcgtctcggttgggctcgttatcgccgtggttgaagcaactacatgaggttgattgtgtgagcaattgacaaatctgaggtggaaccgcggtttaagccgtcctcttacagcaaagtgctgtaagaggattttttaatggtcgcgatttttccgaaatcatgtgtggtgctgcaaccacatgaggccgagtgtgtgaacaatcggtaaactgaggtggtaccgcgcagaagcgtcctcttgcatcaagcaagagggcgcttttttcataccacgaacaagttgcccaaccgctcaactcatcgacagccacaaagcgcaattagaaaagaaacggatctgtgcgactcaaatataggcaggttcaaaggaggaagcaccatgacttatatttttcagattttaccggcattattatctggtgtgaaaatgacgttggggatttttgccatcactttagtcggagccattccactgggtctcattttatcagtcggcttaattcccaagcctaaatcgctacttggtaaggcaggaaaaagcttgctggaaggctatgtgtgggtatttcggggcacgccgctgttgttgcagctgatgtttatcttttacggcctgccgattatcggtatcgtgtttgaccgcttctcagctgctttagtcgcgtttattttgaattatgctgcttacttcgcagaaatcttccgtggtggctttggcgcaattgatgaaggtcagttcgaagcaagtacggtcctcaacatgacccgctggcaggcattgcggtttgtggtgattcctcaggttgtcaagattgtgctaccttccatcggtaatgaagtcatcaacttggttaaggattctagcctggtttacgtcattggcttaggcgatttgcttcgagcaggtaacattgccagtgcgcgggatgttaccttgctgccactggtattggtcggggtcatctacttactgctgacgctgattctgacgttcctacaaaaacggatcgaagcagcattttcatattatcgctaggagggttaaaaatgttagaactcaagaatatcagcaaagcgtttaacgggcggccagttctaaaggatgttaacgtcaagattgaagatggcaaaacgttagcaattgtgggtcccagtggcgccggtaaaaccaccttgttgcggatcatcagtggtttggaaagtgctgatggcggcaccatgatctggaacggtcagccgacgaccgcgcaggctttacgcaaacaaggtgtgatcggcgtggtgtttcagaactttgaattattcccgaatttgtcggttatgcgcaatattaccttggcgcctactttgcagggggttgatcaacaaaaagccgatgcgacagccaagaaacttctgaatcaacttgaactaagcgatcaggcgcaggcgtatccttattcactgtctggcggccaaaagcagcgggtggcaattgcacgggcattggcgctaaatccgcaaattctcttatacgatgagccgactagtgcgctggatccaatgttgcgcgataatgttgccgcaatggttaatcaatttaaagcatccggcatgactcaggtggttgtgacccatgacatggactttgcccaaagtgttgcagacacgacttatcacgttggcaaaggcggtgatggtcaatgaaacggcgaatgataatggccgtcatggtgtttttgaccatggccggtatcgtaatcagcggatgtgcgcgcgaaaccgtcgacaactcctggccgcgcattgaacggaccaaaaaagttgtgattgggttagatgatacctttgttcccatgggttttcgtcaaaaaaatgggcagttagccggctatgacattgatttagccaaagcggttttcaaacggtatggcattaaagcggatttccagaccatcgactggtcgatgaaggaaactgaattgaaaaatcagaccattgatttaatttggaatggttattccgtgaccccggagcggaaagcaaaggttgctttttcgaatgattatctgattaaccatcaaattgtggttaccaaaaccaaaagtcagattaacacgttgaaggatatgaaggggaaaaccttgggcgtgcaaaccggatcaagcggggcatttgatttagatgcccaacccaaattgttaaaaaatatgatcgccaacaaaacgccgatcctttacgataccttcaatgatgcatttattgacttggatgctgggcgaattcaaggcattttaatggatgaggtttacgcacgttactacattgcccacaagccggatcctgcaagttatcacattatcggcgactcattcccgccagagcagtttgcggttggtatgcgcaagtccgatcatgttttaagagagaaaattaacgcgggattgaaggcgttgaaggcagacggaacgattgctaaactgcagaagaaatggtttggcaaggtcgaacaatgagttgtatgttagcgctgataagggttcagagtttagatatcatggcaattttatgttgaagctggaatcattgtggttgtgtggatactgtctattgcgacaggtaactgcatgaaaactttgattccggcttttttgttggttgttcaacacgcctcccttaacgcgttcaccggcgcagggacctgcacatcaagaccttgggcgcaatgaccaaagtatggccatcacgcttgacgccgcttgggttctggtttatgtccataacgcgttcaccggcgcagggacctgcacatcaagaccttgggcgcaatgaccaaagtatggccatcacgcccaaggccacttatgttccggtttctaaccgggctggctcacgctcactggacttttccccctgactttctgtaaagtagagtatgataatcgcatgtagagactggacgaatggctgaggtgtgacattgtctggttagggaggcgaaatttatgtggcttgggctgattgttggcggtctttatatcattaatgcatttattgcgattgtgacggtgtttcggtcccatcgtgatatttctgctgtatgggcgtggctgcttgtgctgttgctgctgccgtttgttggtttcttaatttattttgtcttcgggcgtaaactgcgggcggatcgcatgcaggatttaatgacgcaacggctattgggcattaatgatttggtggttcagcaacaagaagcgcttgcggcagggcagccgttgattgggacgccaggtagcggtggggtttcggagctggtgcggacgttattgcgggcggacgatgcgttggtcacaactcacaatgaagttcaggtgctttctttgcgggaagccttttttaaacagttgtttgaagatattggcttggctaccgaacatattcatattgaagcctatacgattcagcctgatgcagtgggccggcaattgcgtgatttactgattgaaaaggcgcaagcagggatcaccgtgcgcgttttatacgatacgtttggttcgcacggtttaccgattagcttttggaaaggcttgacagcagctggtggtcaggtggagcgatttgtggcgaccaaactcggacggtggaatccgcgcatcaactttcgcaatcatcgcaaactgattgtgattgatgggcatttggcatacttgggcgggtttaatctgggcaaagaacatcgcggtttgccaacactgcgggatactcagctacgaattcaaggtaaggcggttgccgtgattcaagcgcgtttcctgatggattggaatggtactagcaagaagcaacaggtcaaagacgtcgatgtgctgtttcgtgaaccggttgtcaccggaaacacaaccatgcagattgtcgctggtggaccggggcagcaggttgaagcaattaaacttggctatttaggcttgattaatcaagccaagcgtagtatctggatcgagtcgccttattttgttcccgatgacagtttgttggacgcattgaccattgcggctaatgcgggagtcgatgttcgtattatggtgccgaagaaaacaaatcagagtctgatggccaaagcatcgcagttttacctcaatcaagtagttgccaatggtggtcaggcctttttatatgaagagggtttcttacacgctaaaacgattgtggttgacggcaagtatgtttcaaccggcaccgcaaatttcgacatccgttcatttaaattgaactttgaagttgctgcgtttctttatgatcatcatttaggcaaaacatttcaaaaactatttcttgcggatatggaacgtgccatgccgtatacgcaaaaggtcattaaggccaagaaacgaccagcacgcttggccgaagagttatcgcgattgctggcgccgattttgtgatgggctaaccattcactgattttttggtaattaaaaaagccgctgaaaaatcagcggctttgtggttatttggtgatcggattagatgatttgcaaacttgcgagcgcggtgagaacaacaccaagcacggtgataataatcatcacccaagcactaataatcgtcattttctggaatttgctctttttctttttctgcaccgaaaacaccacctttaaagttctgctgggtctcattgtactggtttttggaaaaaacggcaactaaaactgagcgcgagccggcgcggttagaaaccggagtgtaagcggcctcggacgtgatggcccgcttttggccattgcgttcgaggtccttacacgcaggtttctgggctggcgaacgcgttatgggcgtaaagggggactattggccttgggtgtgatgaccgggttttggtcatggcacccaatacaatgtccgtacacgcgaattcctacgctgaagagcgttaacttctgcttgacgcctttctttcctttgagtacggttaattgagaagtatcaacagacagcaccttacgtggttgctgccgctggagggaattgtcatggtgttgcttgcgttgggattaccaattttagtgtggctcttggttgttgccgctgtcgtctatttcgactttcatggtggttcgtggtttttcttactgacaatggtgaacctctgggccattttcgagttaacctttaccaaaagtccgaatttcatctgggtgattctgtttacggcgatggtgattgccttgattctggttgtttggcaggtaatccgcgaatatgacctgattattcaccgatattggcggatgttgacgcgcattctctccctggcaaccacttgttggtggcttagcggtatttttatttattttatgggctgagtcaccaccgacttaccacttgtgaaaaaatcccgtgatccttgtgatcgcgggattttttgtggcttaaatgttttttaaacaataaaataactaaattttgcttcagaagtggttagatgtggagaagagtggggcgttgtggtagactgaaaatcgtagggaggtgcaggccatgctcatgggtgaatttgaacgcagtatcgatgctaaagggcgtctgattattccagccaagtttcgtgagcaattgggtgcatcgtttgttttgacccggggcatggatggctgcctttttggttatccaatcgcggaatgggacaaactgcaggcgaaattggccacattacccttagcaaaaaaagatgcccgcaccttcacgcgttttcttttttcggccgcgaccgaatgtgaaattgacaagcagggacggatcaatattcccaagccactgttcaaacatgcggcgttgaaaaaggattgcgtccttgtaggggtcaatacccgcattgaagtctgggatgccgagcgctggcagcaatttgccgacaccgctgaagaagactttgatgacatttcagaaaacttaacggactttgggttatagccatgacagaatttaaacacgagacagttcttttaaaagaagcaacagcggctttggccgtgaagtcggatggtacatatgtggatgccactttgggacgcggaggccatacccgccagattataaatcagcttacgaatgggcgtctgattgcctttgatcaagacgaagcagccatcgccgcggtcaagcgtcagtttgggacgttaccgccgcagctaacgctggttcaccgaaactttcgggatttaagcgcagccttggctgatttggacattaggcaggttgatggggttttgtacgatcttggcgtatcttcgccgcaatttgacgattcaaagcgtggtttttcttatcgtttcgatgcaccgcttgatatgcggatggatcagcggcaaacgcttgatgccaaaacgattgtcaatgaatggccgtatgctgaattggttcggatcttttcgcgctatggtgaggagcatttttctaagcagattgcgcgtcgaattgagcaagctcgtgcccaagcgccgattacaaccactttccagcttgttgagttgatcaaggcaggaattccggctaaagcaaggcgaacaggtggccatccggctaaaaaagtctttcaggctatccgaatcgcggttaatgatgaattatccgcgctagaagcttctttggaacaggcactcaagctgattaacgttgggggacgcatcagtgtcattaccttccagtcattagaagaccggctggtgaaaaccatgtttaaagaagtgtcaaccgtccaagatgttccgcgcgggttgccggtggtgccggaagctgctcaaccacattaccagttagtcaatcgtaaaccgattttaccgagtgcggccgagctggctgaaaaccatcgtgcccacagcgccaaactcagggtgatcgaaaaaattcgcaattaggggggttccatatatgcttgagagtacagcaaggcctttagtgcaacaaccggcaccgaaaccggtacataaatcagctcctgcacccgcaccgcacacacatattgcttttagcgggttcgagaaaacgatgatgtttgcctgtggcgttttagcaacagttgtttgtgtcgtttgtttgttcatgcaaaatcgcttgagcaacacgcaacgccagtatgaagatttacaggcgcaaattatgaagcaatcgcaagccacggcgaatctcaagcaagaaattggcgaactctccaactccgaacgacttgatgcctttgctaaggcccatggatttaaagtcattaacggcaatataaggcgtgttgataatcaatgaaaattttcaaatcgaaacgatcaacgaatgcacatccagcccgcaaccgtaaatttttcggtattgggctgatcgggtttacgcttctggtactcggtgggttcgttcttcgtttttcttttgttgcgaccattggcgaagtggattcaaataatctggcgaagcagcggcaaaagcagtatcagaccgacaccgttttgcaagcgcagcggggtgctattttggatcgtagtggtaatgtgatcgccgaagattcaaatacgtataccatttatgccatcctcgataagcaaaacaaaaatggcgataagcctgattatgtcaccaacaaagctaaaacggccaaaatactgagtcgttatttggcgattggtgaagataaagttttagcacgtttaaatccaagtaagaatcttttccaagtcgagtttggtcggccagggacgaaattaagtttggcgatcaaaaaacaaatcgaagctgagaaattgccggggattcattttcgcgaaaccccatcgcggctttatcctaatggtgtgtttgccagtcatgtgattgggttggcacaagcgcaggataatggcggcggtttgaccggggtgatggggttagagaaacaatttaataccgttttaaccggcaccaatggctatcggcgaagtgaaacagatgcatatggatataaactgcctaatgccaagaccaaagccaaggccccagtgaatggcggcagtgtctatacaacgcttgatagtggccttcaagcttatttggaaactcttatgacagacgttcaaaccaaatatgaacctaaaggcatgacggcggttttgatgaatgccaagaccggacgtattttagctgccacacagcgtccaacgtttgatgcttcgactggcgaaggattaggcgatatgtggcgggattctttggttgaggataattatgagccgggatcggtaatgaagatcatgaccttggctgctgctattcaaagcggtaagtatcaccccaatgaatatttccagtccggatcggttaagcttgatggcggcacggttaacgattggcggacaggcggctggggatccattccgctgagcaaagcgtttccgttatcgagtaatgtcggcatggttaagatcgaacaggaaatgggtgccggcatttggaagagttatttggataaatttaaatttggccaaaaaaccggcattacgttaccgggagaaacaagtggccggattagttttcaacgtccattggatcaggctatcaccgcctttggtcaaggcattgaagtcaatgtgatgcaaatgatgcaggcaatcagtgcggtggcaaatgatggcaagatgcttaagccgcagattgtatccaaggtggttaacaagaacggtaaagccactgtttataagccggaagtggtgggtcagccgatctcaaaggaaacggcagctcaggttattgatgccatgcgtcacgtggttaatgacgaagacggaaccggggtggcttataaaatgccgggtgttgacttagccgttaaaaccgggaccggtcagattgctagtgctcaaggcggctatttaaccggggattccaattacacgtttagcgttgccggaattgcgccggcctccaattcaaagtatgtcttatacgttgcgatgaaacagccacagaagatgacggaaccagcagaatcaatcttggcaagcatcttcaagccgatgatgcaacgggctttggacacgacagcgaatagcacggtgtcaggtgaaaccaacactgctgaagtgcctgctgtcaccaatgcggcattggcgagtgcacaggataccgttaaaaaggccggatttgacgtagcaacgatcggaaccgggaataaaatcgtccaacagttgccagcaagcggaaccaaagcattgcgggattcacgggtgttacttttgacgaatggtgccatgacgatgcctgatctcactggttggtcgaaatccgatgtgttaaaatttgtacaattgaccggcaagaaatttaagcttgtcggtgatggcttcgttgttcggcaaagtattgctaaaggcaccttattaggtaatgccagcgggacaatcgagtttaaacaacaatagaattggggatagtcatgcaacttgctcaaatgctcattccaatggtttcggcatttgccattaccattatgtttatgccgctttttatcggttacatgcggtataagaaagaaggccaggtgattcgtgaagaaggaccaagctggcacgaaaagaaatcaggcaccccaacgatgggcggcttgatattcattgctgcgatcatcatctcggctatttgggtcagcatttggcagcaccaactaacgctgagtgtctggatttccttatttattttggttctttatggcttgttaggattttatgatgatttccagaaattggtgcaccatcgtaatgaaggcttgaaggcgtggcaaaaattagccggtcagatttttggcgctgtcatttttctgatcgcttattttcacgaaggctttgatcatacgttatgggttccggttttaggtaatgtcaatgccacgtggttttatgtgatattcgttgttttttggctcgttggttttagtaatgcggttaatctgacagatggtttggatggcttggttgccggacagacgaccatttcgtttgcaacgtatgcagtgattgcggttcgtgaaggccgcgttgacgtgttgattatttgtctggtgactgtcggcgcgatgcttggatttttgatgttcaatcataaaccggcccagattttcatgggcgacctgggatccttagcattaggcgggatgctggcagttgttgccattttgcttcatcgagaatggtcgttattattgatcgggatcatctatgtgattgaaacagccagtgtgatcttgcaggttgcttcattcaaattaaccggcaagcgaatcttcctcatgtcgcctattcatcatcattttgaaatgaaaggctggtccgagtggcagattgacttgaccttctggctggttggactgatcgcaagctgtgtttatctggtatttttcctataaaatcaagctataaaaagaaggaacgattgtgaaaaacatttcggattatcgtaataaaaaggtgcttgtattgggactggcaaaaagcggcgtcaatgcagcgcgcttactacataaattaggggctttggtaaccgtcaacgataagaagcagttcgatgacaacaaagaggctcaggagttgttggcagacgggatgcgcgtgattaccggacgccatccagttgaattgttagatgagcattttgagttgatggtcaaaaacccgggtattccatacagcaatccgatggttcagcgcgcgcaagaattgggcctgccgattattactgagccggagctagcttttcaggtatccgaagcagagtggatcggcattaccgggacgaatggcaagacaacgacgaccacgctgatcgggttaatgttaaaccaacagtggcctcaccatgcgtttgatgctgggaacatcggcattccggtcagtcaggtggcacaaaaagcaggtaaagaagacactattgttgctgagctatctagttttcaactctgcggcattaagaccttgcatccccatatcgcagtgttaacgaatatctatgaggctcatttggactggcatggcaaccgcgctaattacgttgcggcgaaaatgcgcattacgatgaatcaaacgccggatgattactttatcatgaactgggatcttcccgaaatgcaccagttagcaaagcaaagtcaagcccagattgtcccgttttcgcgcaaacaggccgctggtgcacgggcttcgttaattgatggctggttgacgttcgatggtgacaagattatgcctgccagtgacctgcagattccggggttgcacaatatcgaaaacgccttggctgccattgccgcggccaaactgaaaggtgtgagtgatgacgcaattcgtgaggtactgcggactttttctggcgttaaacaccgaattcaatatttggaaacgatcaatgggcgtcgggtatacaatgactccaaggcaaccaatgtcgaggcggcaaccgtagccttgaatgcattccagcaaccaattgtttggttggcaggcgggcttgatcgtggtttgccgatggatgctttaaccccgctcgttaagaagcacgtcaaaagcatggtcgtattcggtcaaaccgcatcattaatggcaaaaattgctaaagatgccggtgtcccggttcaaaaaaccgagaatgtcatgacggcggttccattggcctatgaagccagccgccccggcgatgtgattttgctttcgccagcagcagcaagttgggatcagtatcctaactttgaagtgcgcggcgatgatttcatcaaggcggttcatagcctacagcaaaatcttgaaagcgagggtcattaaatgcggctggttatttctggtggcggtaccggcggccacatttatccggctttagctttgattgaagccctaaaagcagaaggcaaacttgatgatgttttgtacgtgggcacgcaaagaggcttggaaagtcggatcgtaccggcaaccggcttgaagtttgcaaccctggacttgcaaggctttaagcgcagcctttcgttaagcaatgtgacaacggtcaaaaagtttatcggcagtctcggtcaagccaaaaagttattgcgagattttaagcctgatattgtcgtggggactggcggttatgtttcaggggccattttatatgctgcggcacggttgcatattcccacggtgatccatgagtccaattcggttgctggggtgacgaataagtttttaagccattttgtcgatcgagtggcgattgtctttccggaagttgcatcctcatttccggctaagaaagtcgttgtcaccggtaatccgcgggcacaacaggttgccggcttaaagcccaatgaccggcttaaagattttggactggatccgcataaacgaacacttttgatctttggcggttcgcgcggtgcccctaaaattaatgcggcagctgttgcggcgttgcctgtttgggctaaggcagactttcaagtgttatttgcaactgggcgcagtcactatgacgccattaatgcgggcttgccagcgttaccggcatctattaaggtcgttccgtacattgatgacatgccatcgattttaccggacatcggtttgttgattagtcgcgccggtgcaaccacacttgctgaaattacagcactggggatcccggcaattctcattcccagcccgaatgtgacccaccaccatcagtacctgaatgcacaaagcctaaccaaaaaaggtgcggcattaaccattaccgaaccagaattgaatcagaattttccccagcgcgttgtgactttgatggaagatgatgcaaaacgcgctgcaatggcacaggcatccaaaagactgggcgtgcctgatgcaagtgatcaattgattgcggtgatgacaacactacttacgaaacgtgggtgatgactttggcttggctccgaaaaaaagaacagcaatctgatccgctgacgccgtggcaacaataccaggcacgccagcagcagacgccgcgtcatgatcggcgccaaaaaccgaagttggatgttaatctcccgaagatccagacgttgcggcgccgtaaactcgtgaagaaccttgttttgattctgctccccctgctgctattgctgggggtttttggctattttgccagcccgctatccaaagtcggacttgtgagtgttcaaggcgtgacaacggttccggatcagcaggtcatcaacgcgactaaattatcagacgatgacttgatgttgagtgtggcatttcataaaaatgccattgcgcagcgggtgcagaaatctttaccagaaattaaaacagccagcctgacgatcaagggattcaatcgtattattattaaaaccagcgaatatcagacggtcgggtatgtttatcaaaaacacgcgtaccacaagattctggttacgggggaagtgttagccgccggaacccaaacgccagtcacgacttatccggttttttccgggtttacagccaaagagttaccacaaatgattacgttacttaaacagttccctgctgccattcggcgtgatatctcggaaattgacgccagtcgcggggatgccaatcctaaccagattgcgctcaacatgaatgacggttatcgcatcattgccgatacgcgcaccattgccaagaaaatcaagtattatccggcgattgtttcacaggttaagcaaaaaggcgtggttgatttggaagtgggagcattttggcgaccgtattctagtagcgaaaagtcgtcaaatgactgattttgtaaggatcgttttctcatcagaaaatgagtgtgttacactgatgatggcaccgttttaatatgaaaattgagttaattaaaaagttacacaaggaggttcccgatacatggataatcaaggtatttacgttggacttgatatcggaaccacctcaataaaagtcattgttgccgaagcagtacagggacaaatgaatgttattggtgtgggaagtcagcggtctgaaggcgtgagtcgtggggtgatcgttgatatcgataaggcagtcgcagtggttcaagcggccgttgcccaagctgaagacaaggcaaatatcaagatcgatcgggttgtagctggcatccctgctaatatgctgcagattgaacaggtttcggggatgattgcggtcggcgaggaaaacaaagaaatttccgataaagacgtgcgcagtgttgctgcggcagcattagtgcgtaatctaccgcctgagcgtgaaacattatcgctggttccaaccgaatttatcgttgatggctttgatgacattaaagatccacgtgggatgttgggtgttcggctggagatgcgcggtattatgctgacagttcctaaaactgtgattcataataccaaaaaggccatcgaaaaagccggcttgcgagttggcggcttggttatttcaccactggctattggccggcttgcgttaacggatggcgagcaggactttggcaccgtcttgattgatatgggtggcggtcaaagcacggcagcagtgattcatgaccgtaagctcaagttcacttcggtggatcaagaaggcggggaatacatcaccaaagacatttccgtggtgttgaataccagttttaccgatgccgagaaattgaagcgcgagtatggaaatgcggattctctggctaccagtgaagatgagacttttccggttacggttgtcggcaagcatgatccggccatgatttcggaaaaatatctgtctgaaattatcgaagcgcgggttgctcagatattcaagcgactcaagaaggcactggatgcggttaatgcgcttgagttgccgggtgggattgtcattaccggcggcaccaccgcactgccgggtgtcaccgagttagcccaggacattttagagcgaccggttaaacggtttattccggaagatatgggcctgcgccatccgtcatttactgaagggttagcgctcatcaagtacgccgctgaaatgacggatattgaaatgcttgtttcaagcgttttgccaacaccgtttatggttgatggggcgcaaatgccaacgcaaccggcacggccgcaacaagaaaccccggcggcaccggagaatcaacgttctgccaagcgcaaacctgataaacaacccgaaaaagcaaaatctaaggaaccatctcctttacgccggttctttggtaatttctttgaataaatctcgatcctaggaggaacacgaatggattttcaaatggacgcacaaagtgaaaaaggtgccaacatcaaagtaatcggtgtcggcggtgcaggcggtaatgccattaatcgcatgattgcagaagatgtcaaaggcgttgaatttatcgctgccaataccgatttgcaagcattgaatgccagcaacgcagaaaccaagatccagctcggaccgaaattgacgcgcggcttgggcgctggttccaacccggagattgggcaaaaggcggctgaagaaagtgaagaggcgattggggcagcattgcaaggtgccgacatgatttttgtgactgccgggatgggcggcggctccggaaccggggcagcgccaattgtggccaaaattgccaaagatcaaggtgcgctgaccgttggggttgttacccgcccatttacgtttgaaggccctaagcgtgctaaaaacgccactgaggggattgctcagttaaaagagcatgtggataccttggtgattattgccaacaatcgtttattagaaattgtcgacaaaaaaacgccgatgctggaagccttccatgctgcggataatgttttacggcaaggggttcaaggtatctcggatctgattacaagtccaggctacgttaaccttgattttgccgatgtaaaaacggttatggctaatcaaggatcggcgctgatggggatcggcagtgcaactggtgaaaatcgcaccgttgaagcgactaaaaaagcgatttccagcccacttctggaagttaatatcagtggggctaagcaggtgctgcttaacattaccggcggcccggatctcagcttgtttgaggcgcaggatgcttcacaaatcgttgcggatgcagctaaagatgatgtcaatattatctttgggacttccatcaatgaagagctcggagatgaagtggtggtaaccgtgatcgccactggtatcgaagaagaagaccagcgccgcgaaacaacgcgccggccagccgctgccaatcgtaacactgatcagacccagtcaaacgggtcgtatcggccaacattcggcgggcatgaacagtctgccgatcaagcccctaaaaatgatgatccgtttggtaattgggatttgcggcgggaaccaagcaagcgccagaccccgagtgcagatgatatgaacaacgttaagaagaaagattttgatattttcgagaatcaaaccaatgcagacgatgcaggaagcgatgatcagccgccattctttaaacaacggcggcgtcagtagtcaggaggtcatgaaacatggcgtttggaaagttaggggaaaaattcaacaatttctttgccatggatgacgaagatgaatatcaggaccaagaagacgaacaaacgcaggctgcacctaaggaaccttcaaatcatggccagtatcgtagcaacaaagtcgtatcaatgaatagtccggttggtaaaactgccaaaatcgttgtgtatgaaccgcggatttattcagatgccaaagagattggttcgcatttactgaacaatcgcgcggtcgtcattaactttgatcgaattgaggccgatgatgcacggcggattgttgatttcttaactgggactgtttttgcgattaatggtgagattaagcggattggtgagtcgattttcttagtcacgccagccaattttgaaattgatggttcattggctagtaccattgattccgatggtttgaatctctcatcgcaaccataaacgaggtgtcaagtgtttaattttctttatgcattatttcgagtcggcgattgggcgatttatttatacatgatcatggtatttatttatatcctgatttcatggtttccaaacgctcaaggaaccgccattgaccgtttgttaggccggtgggttgatccgtttctgagtatctttcgccgtatcattcctgctattggtggacttgatctttcgccaatcctggcgttcttcgtgctttcgctgattaagtttggatggtcgcggttgtttctgatacttgttcaaataattgggtgacaagcatggatgccatctatcaacattttcgcaaagatgaagcagcattgattgatcattttgcagaattaatcgaaactgcgcggactgagtatcgggcagtattaaccgattttaccgatcctaggcagcggttgattgctgcgagcctgatcaatgcacatgatgatatgaagttggtacatttcggcgggtatccgcatgctgaacggcaacggctgatttttgcaccggactactttgccgctcagccagctgattttgatattcggcttttacaagtggtgtatcccgaaaagtttgccgaaatgcatcacagtacgattcaaggaacattgttaaatgccgggcttgatcgggatgttttcggcgatattgtgacggatgggcgtacctggcagttttttgttgccgcgcatatggaagattgggtgatgagtaatatcaccaagatcgggcgtgtcggggttcattttacggactatccgttagccgctgccgttacgcctgaaaatgactgggaatccatcagcttttcagttagtgcactgaggttggatgccatcgtggcccacggtttcaatatgtcacggcagcgggccaagatgctaattcaggcgggaaaagtccggctgaactttggcgaaaacgatgcacctgacgctgaggtcgccacttctgatattatttcagtacgtggatttggacgattgcgactagatgcgatacttggtgaaagcaaaaaaggtaaattgcgtgtctctgctgccgtgattcataagtaaaccgtatcgtaggcggttcaatgcgcttggtttatcgatagcggcaactttttaacaggttgcagcaatcagcgcctgatgagggacgtatcaataagctaaagtacgttcatgatcacgcgtatgccggcctgacaagcggttggcgcacgttcactagaggaggaggactatttatggctttaagtccactggacattcacaataaagaatttagcagcaagatgcgaggttatgacaaggatgaggtcaatgattttcttgcgcagatcgttaaggattatagtagcctgatcaaggataatgaggggcttaagaaggaattagcggatgcaaaagaaaaggtccgttacttcaccgatatgaaagaagccttgaatcagtcaatcattgtggctcaagaaagcgctgaaaaggtgaagaacagtgcgcatcaagaagccgatttgatcaagcagcaggcgcaacaagatgctcaggggatcctcaaccgtgctaaggctgatgctgatcagaaagtccaccaagcccaggcgcaaaccgagcagacgttgcatgatgccgaacttaagcgtcagaacatttctgttcaaacagaggatttgaaacgccagagccgggttttccgtcagcggttacaggttatgctggaatcgcagttggaagttgtgaaaagtccggaatggaaagaattactgtccagttctcctgaagctgcagataccacggatccaagtcaagaagcacttgacaattcgcaggctggtttcgtaaactctagtggagcagtttccggtgctgatgcgtatacggagattattttcccagatgaccaaagtgcaacatccgagtcggcaactgcaacgccggcaccggcggattcggagcgttccgaatcagaagcgtcaacaagcgcaaccacaagtgccgataccgatgttacaactgatcaaaatgcacaataacgtatgaacacgcgtcatttgccggtcccctttgcagcgagtcaggaataggtgtgagcctgataagtaccgctgaatgatatcagttcgcagttgtctcgccgaataactaagcgagaccggttgatcaccgttaagcaatcactgagggggacttgttccctgaagttaggtggtaccacgtttgctcgtcctaatatagggcgggcttttttcattcaattaacaaaggagcgggacacgtgaaaattaaagatacgttgaacatgggcaagacgacttttccaatgcgagcaggcttgcctaaaaatgaaccgatttggcaaaaaaagtgggatgaagaccacgtttacgagcaacggcagaaattaaatgaaggcaagccgacgtttatgctgcatgatggcccaccgtttgccaacggaaatattcatatggggcatgcgcttaataaaatcagtaaggatattatcgttcggtataagtcgatgaatggcttccgggcaccttatgttcctggctgggatacgcacggtttgccaattgaacaacagttggccaaacaaggcgttaaacgcaaggaaatgtcaatgaccgactatcgcgagttatgccggcagtttgcgatgaaggaaattgataagcaacggactgatttcaagcggcttggcgtcatgggtgactgggaacatccgtatattacgttacaacatgcttatgaagccagtgaaattcgggtctttggtgccatggcgaagaaaggttacatctatcatggcttaaagccggtttattggtcatggtcatccgaatcgacgctagccgaagctgagattgagtatcatgatgacaaatcaccttcgatttatgttgcctttccggtggttgatggcaaaggaatcctggatcaagatacgtcacttgttatttggacaacaacgccttggaccattcctgccaactacggcattgcagtcaatccgcgcttcgattacgtccaggtgcaagttggcgagcataagtatgtcgttgctgccgagttgcttgatcgggtagctgaagaagtcggctgggaacaacctaagattttaaagacttttaaaggcactgaaatggataagatgacagccaagcatccgttgtatgatcggacaagtctagtgatgaatgcggatcatgttacgcttgatgccgggactggcttggttcatactgcccctggtcatggggaagacgactataaggtcggaatgaaatatggcttgccggttatttcagtggttgatgccaaagggtacctgaatgaaaatgcccctggttttgaaggcgtcttctatgatgatgccaacaaactcgtcacgaaagctttggacgaaaaaggcgccttgctgaagttggacttcttcacccatagttatccgcatgattggcgcaccaaaaagccggttattttccgcgccactacccaatggtttgcatcaattgaggcctttcgtgatcagattttgaaggccattgatactgttgactttaaaccgagttggggcaaaacgcggctgtacaatatgattcgtgatcgcggcgattgggtcatttcccgccagcgcgcatggggcgtcccattaccgattttctatgcagaagacggtgagccgattattgaagaagcaacgatcaatcatgtagcggatttgtttggtaaatatggttccaatgtctggtttgaacgcgaggccaaggatcttttacctgatgggtacaccaatccgcacagcccaaatggcaagttcactaaagaaaaagatattatggatgtttggtttgactcaggttcatcgcatcaagctgttttggcacaacgtcctgaattgagcttcccggctgacttatatctggaaggttccgatcaataccgcggctggtttaactccagcttgattaccagtgttgctgcaaccggaatcgcgccgtatcgcgggattttgtcacaaggcttcacgcttgatggcaaaggccggaagatgagcaagagcttgggcaatacgattgtgccgtcaaccattgaaaagcagtttggcgctgagatcattcggctctgggttgcaactgttgattcatcatctgatgttcgggtctcagtcgataatttcgctcagacgtcagaagcctatcgtaaaatccgcaacacgctccggttcatggttgccaataccggcgatttcgatccggaaaaagacgtggttgcctatgatcagctaggttcagtggatcgttatttgttggttcggcttaatcaggtcatcgccaaagtcaaagaagcgtatgatgcctacgactttgctacggtagagaaaaccatcagcagtttcctggtcaacgatttaagtgccttttatctcgatgttgccaaggatgtggtatacattgaagctgcaaacgatcctaaacgtcgcagcatgcaaacggttatgtacaccgcattgctggacttgaccaagttgttgacgccgatcctgccgcatactgccgaagaagtttggccgtatcttaagcagaaacaagcatacgcagcgttatccgacatgccagatgtgacccactttgctgatgaggatcagctcttagatatctgggcagcgtttatggattttcgttccgaagttcaaaaagccttggaagttgcccgtgacaacaaggtaattggtaagtccatggaggcagcggtaacagtttacccaacggagccggtacgcgacatgctcgatgatgttgaagccaatgtgatgcaattgctgattaccagtcactttgaagtagcgccacttgaggcgaaggcgccggaaaatgccgaacattttgaggatatggctgttgtcgttgaacatgccaaaggaacggtttgcccacgttgccggatggtacgaaccgatatcggcacagatcccaaattgccggaattatgcagtcggtgtgccgcgattgttgaagctaattatcctgaagcggcagcaaacggatttgataagtaagcggaggctatgatgcaaggacgggtcaaaaatttcaacgtcgataaaggctatgggtttattgaagctgaagggcagcctgacatttttgtccacttttcggcgatcaatgagtctggatttaaaagtctgacgcccggtgaacaagtcgattttgtcattgtcgaaggtccgcggggtccgcaagcagcaaatgtcacgatccatcacgaacccgacactgaggatcatgcataaattctcgttcaatcgtgtgacgtgattcattaaaagcaatccgaacagtctgtctttgggtgacaagctagtaatgcttcctagcaagtacgtctgtggctgtcaggattgctttttaatgttgacgactcaagtttataggacaataagaaaaccgcgatcagtgcgttgatcgcggtttttgtatacatgctgctttttatttggtgatgctgggtaggttacttgttaacttcttcaatcttaccgtcataagtccgagcaacggtcatcttggtgattggaatatagcctaactttggaaccagggtcttttgaacgttcttggactggatatagttgataaatgcggcagtcgatgcattcggcttgcctttggtgtacatgtgttcgtaagcccaaatcttccaggtgtttgttgtaacgttcttatcagttggttgtactttatccagtgccagcttttggacgccatctttaattgccgagaaggctagatagctaatagcaccgggagttgaggagaccatctgataaacggtaccgctagaatcctgttcctgactggtcttgactttatcggtcttgatcccgaactgttcgaaggttgcccgggtacctgaaccttgcgcacgattgatcagaacaatttgctgatctttgccgccgacgtctttccagttcgtaatcttgccttggaagatatcgatcaattgctgggttgagatgttcttaacccctgcatctttgttgaccaccggcgcaatggcaacgaccgctacctggtgatccaccagatcatcggccttcaagtctttcttttcttgagcgaaaatatccgagttaccgatcgtgaccgatccggctgccacttggcttaagccggcaccggaaccaccgccttggacagtgatctccgcctttggattatctgtctgatattgtttcgcggcctgttccaccagcggttgtaaggcagtggatccgaccgctagaattttgctttgttttgccggtgctgaactggatgaacttgaactgctggcggattttgacccgcaacccgttaataccaaagtggcagttaaggccacggtcaaaccgactaacaatttcgaatgcttcattacttttccctccaatacttgaataactttaggatacgatttgtgtgtaaagacttgaccactttgatgtaaataatgcgttttgcttttgtaaatatgttcaacagtcctttgaaaaagtaaccaaagtcggcgtataatgactcagttaggcgttattaaaggagcggaaaatgtgaaaaattacattgaggatcaaaaagttcagaaaaaccggtggtggatcatcacggcaattgggatgtttaccattatgtcgacattggatggttcaattgtcaatattgcgctgccggtcatgagtcgcgatttaaacattccaatgaatcaagcggaatgggttgtttccatttatttgatgatgatctgcggcttgttgctgttctttggcaaacttggcgattcgatcggtaaaatcaaagtatttcgaattggcatggttttgtttttaatcggctcgctttttgctggtttcaataatagtttggcgttattactggcggcgcgaattgtgcaggcgaccggtgcttctatgaccatggccaataataacggcatcgtgacggaaattttcccgatgaatgaacgtggcaaggcgctgggattgattggttcatttgtttcgatcggcgccattgccggacccggaatcggcggcctgattcttggtcaactgccatggggttatattttctggattaatattccaattgggattgttgcacttattctgggaacagtcgtcttgccaaaagatttgccaagtaagcgggtgccaatcgattggtcaggatttattagttttctggcgttcattctcacgctttttatggggatctttttgggtcaggaacgcggatttactgacccgctgattcttgggttatttgtaatcgccgtgattgcgttggctgcatttgtacaaattgaacgacacaaaaatgatcctttggttagttttaaattattcagtaacagcgcgtttacactgagcttgttgtcggcattcttcattttcgtaaccaacttcttttttaacgtgatttcgccgttttatttgcaaaatgcgcgtgggttatcaccggaaaaagccgggtacttgttgatgatttttccgattgtgcaggttattgtggcacctgtagccggttcaattgcggatcggatcggaccttatcgaattaccatggtcggcttgttgtttattgttggcagtcagatcggctatgcattgtttaatttacaaacgtcttttgtttttgtcgcgttgatgatcggcttggttggttttggtaatgggttgtttcaagcgccaaataatacagtcgtgatgtcgagtgtggcgccgcgagatcttggaattgctggcgggatgaatgccttggcacgtaatttgggcatggttgtcggcatttcgagtgcgaccacggtgctattttcctcaatgagtcatactgccggacgcaaggtgacgacttatctgacgggtcagccgaatgtgttcatcgccggtatgcatgtgtcattttgggttgcaactgccttatgctgcctagctctggccttgacgggttatcggatgtggcagatgcgcacacaaacgcaggcatgaattcggtgatgagaactgataattgctgaatcgtacaactatacgcaaaaagcccgtgatcatcgtatgatcacaggcttttttcaaagtattgacgcaattatcaatggcgactgagtagatttaacttagtgtggcgtcacgtctttgggattttgttcgttcatactgccgtgcgtgtagtttaataattgttgctttaattcgccttccatttgtactaactgcttttcggcattttggcgttttagacggccgtcttgttggatctgcaaggtttgtttcaaggtatcgataagatcgttttgggtttgggtcaatgtttcgatatcgacaacgccgcgttcattttctttggcagtttcaattgagctgattttcaacatttcgctgtttttcttgagcagatcattcgttgtttccgaaacctgacgttgggcggttaccgcatttttttgccgtaaaagcgtcagggcgatggccacctgattcttccatagcggaattgctgtgttgacgctggcctgaattttttctgccagtgcttgattggtgttctgaataaggcgaatctgcggtgcttgctgaattgtaatttggcgcgccaactgtaagtcatacgcacgtttttccaaccggctggcaaattgcttgagatcattgacttgttggatcgccatttgatcattagcggcttctgcggctttggctgcttcgggaatcgttttttcatttaactccgcgattttgagattggccgcttcgatgtaaatattcagggcatcaaaataggctttattttggtcataaagttcgtccaaaagtttattgtcatttaacagaccttgttgtgaagtctcaaggcgattggcaatggtgtcgatttgcgcgccaatcttttgatacttagccgtaatttcgtagatcgagcgcttgacacggccaaagattttgcggaaaatattattattttctgcttttagctcatcggggttggcctcatttaaacgtgtcatcaagctggttaaggcatcaccgactgcaccggtatcctgactttggacttttgtcagcatattttgggaaaagacgccaagctgcttttgagcatcggcaccgtaattaagcacggtttcaccttttgtgacatcaattttactggctaaatcccgtgctttggcttcctgttccggattcaacttaggtttagctgtcgtcgcttctgggatgtttggctcggcagtggcgtctgttgctgtgctgaacggatcagctaataaatcatccgtcaaattggtttgtttatcatcgctcacgttggtcactccgtttcatgagttttttcgggttcaaggtgttttttagctaagcgcacatcgctatcgagatcatctaagtcgtctttaatgaaggcttggtaatcagtgcgaatcttgccagccatattcgtcatggtttcaaaggctttatcaagcgtttcataagtgtccgcggttttaacctcatgatgggtaatttgagcatacttttgcatgagatccaacagatttggcacttgttgatagacgaaggtacccgcatcggtcaagcgttgcggtgcctgaactagggcctcaaaataagcgtggagtaaatcgactaaatcagtgtttaaggttaatgcccgtaatttggggacttgttgggttaaggcttcaatcgtgcgaatttgctcggcaagatcggccatcgtctttctgaaaagtttgatttcttcttcacttaatccagatgccgcatagtgttccgccattttgggatctaaacttggcagactggcagattttggcttgggccgactcaattcaccgataaagcgggcaaatgcgaaaacggcaccgacaaaaatggcaatgagccatcgtccggacaaagcacctaatactgcacccatggcggcccagagtatgattcgccaagtgcgaatacgtttgcttgtggccacgagatcacttcctctttcgtttgagtttagtttagcacacccttgtaccttgcctatcagccgtaagttggatattcgcaaattttttgttaagaacaagcaccaaattgtctgctggtgtaagctgatgacatggctaaaaaaactgatcgtcaatcggacttaagagcattgacgaataacgacactattttaacaggaggcgatcatggtggaagaaaaaccaattgcccagcaacgcttgtttaccggtcacttagttgcggttgatgaactgacggttaaattggataaccagcagacggctaaacgtgagattgtccgggcgcacccagcggccggcgtgttggcgctcaaagatcagcgcgccttattcgtgagtcaatttcggtcaacagtcgggcagctgacgttggagattcccgctggcaagattgcgccaggcgagatgccattagcagctgcccagcgcgaattaaatgaagaaaccgggatgcaggcgcgcgactggcaaccgttggcaagttattttcagtcactcggtttttccgatgcaaccatggcactttttttagcgcgtcacgtcacaaccgctgagcatcatttggatcaggatgcagatgaatttgtccaacatcgctggttaacgctaagtgaagcgcaacaggcagttgacgatggccaaatctgtgacagtaaaacgctgctcgccttgttgtattggcagctgcaggaggggaattatggcagaggttaatacacgcaaagcataccgtgaggagcaggaaaaagcgcaacgagcggctcgtgaacgtgaagccaaacggattgaggttgaaaaggcctatgcgcggcagaaacggggaaagcctgaagtaaccgcagcccggtttgatgacgtcacttttcgtaaagtgaatagtctcaagaaacgtttgaattgggcaatcggtattgttgtcggtttgattgtgatcgtctttttggttttatactttgtctaacttagacgctgataagatcaggaaagtttatgatcagattcacgacattaatttaaagaaagaatgaggcgattttttgattaaggtcggggttatttgtgcgatggaagaagaaattcggacgttactggctaaacagactcatcagcaagaaacggtgattgccagccagcattactttgaaggccaaatagatggtgttgatgttattttggtacaatccggaattggcaaggtacaagcagcgatgacgactgccttgctgttagcgacttttaagccggatgttgttgtcaatactggcagtgccggtggtatcggtcgcggtttggcgatcggtgatgttgtgatttcaagcggtgtggcttatcatgatgcggatgcgaccgcgtttggctatttgccggggcagttgccacaacagccgcagatttttgaagccggcatgagttatgtgcgccagattcaagctgctgcgacggcgaccggcttgacgtcaaaagtcggcttgattgtttcgggcgatcagtttattaatggcaaagaggcgattgcccgaattttgaaaatttatccacaagcgcttgccagtgagatggaaggcgcagcggttggccaggttgccaaggaatttcacaccccgtttgttgttattcgggcaatgagcgatgtggctgatgagcagtctggggttgatttcgacaaatttgtgatcaaagcaggggagcaaagtgctgcgatgttgttacagttctttagtcatttgcaacgatcacagcataattaggagtgattgtaatgcaacacatttatctcgacaatgctgccaccacaccgatggctcctgaagtcattcagaccatgacggatcaaatgcaacatgattttggcaacgccagctcgactcactggtttggccgggaagctcacacggtaatggacaaaagccggaaagttttggcggactcgattcatgcccaacccggcgagattgtgatcaccagtggggcaaccgaaagtaataataccgctatcacccagacggcacatgcgcatgcgtcattaggtaaacacattattaccacggcgattgagcatccctctgtgttacagccgttaaaggcccttgaaaaagaaggttatcgcgttacctatttgcctgtggatgagaacgggcgtatccggttagctgattttgatgccgcgctggatgacgacaccattttggtcaccatcatgatgggtaacaatgaggtcggcagtcggatgccgattagtgaaattggtgcacggctggttgaccatcaagcctggttccacaccgatgcaacgcaggcgtatggcttgcttgatattgacgtcaacgcacaacacattgatatgctgagtgtttcagctcacaagattaatggtccaaaagggattggctttttgtatcgcgatccgaaagttcagttcccagcgcttttaaaaggtggcgaacaggagctcaaacggcgtgctggcaccgaaaatatcgccggaattgccggtttcgcttctgccgtaaagttgattacgcctgaggaaaaggctaagcgccaaagcaaatatctcggctttaagcaacagattatgaccgctctagatgatgcagaggtgccatatgcggttaatggcgatattcggccggacaatgtcaatcatgtgttcaatttgtggttaaaagggatttcgacttatgcgcttcaaacgaatctggatttagcggggattgcggtatctggcggatcagcctgcacagcgggatcactggagccatctcatgttttgacggccatgtttggcggtgatagtccgcgtttgggtgaatcaattcgcgtttcttttggcgggcagacgactgcggatgatatccaggcgtttattgatacgctgctgccgattattaaacggttaactgccaaacaaacgagtcggtagctttcggaaaagtaggcagtatcatcttgagactcgttagggcactgtgaagctaagcgatggaaaagaagacacttttcgggcaatcccgtgatgtgctaaacttatgggtagttaagcgtgttcataatgcacgtgtcttgcgttttacgctcatattaacgcgttctccagcgcagaagtctgcgtgtaaggacctcaggcgtgatggccaaagcccggccatcacgcctgaggccacttacactccgacttctacccgcgccggctcacgctcacattaacgcgttctccagcgcagaagtctgcgtgtaaggacctcagtcgcaatggccaaagcccggccatcacgcctgaggccacttacactccgacttctaaccgcgctggttcacgctcaggaggtttggtaatcatggctttagcttcaaccggatcggctcaaggggatcctaagacttatcgaattgggtccaacttaaaacgatttacgttaattgatttaggctttgttccaacgaagaatggtaattttcagcttcagcggtcgttggatcctaattcaccgtatacagcggcgaataaactgaagatgacggtggctaagacgctggacaagtttcagcttgatgtgaccacaggcaacgggcttaaggcaattaacattttcaagaatgacagcacgaaggaaaatgttgaacaatatgaatattggattaacaatttcattgaacgtggtgtgctcgagcctaaataagtctctttgaaaatcacggtaactttccttttaaacaagcggagattaccgtgtttttttgttgcatgaatcacggattaaagcgttacgactggtaaagcatgagccacatcacggatgcgtggttttagtgaggcgaatgtcgtgaccgccaaatcaagtgaccaaaagtggtaagctggaaacattgaaattttgatatgaaggagggcttgtatgtttgaacatgggtttattgaggtacatgatgccaatcagaacaatttacaacatgtgaatgtgaagatacctaaggatgccattacggtttttgtggggcggtcaggatcaggcaaatcatcgttagtgttcgatacgattgctgcggagtcacggcgggagttgaacgaaacttttccgagctttacccagcaatatttaccaaagtatggccagcctgatgtcggttcgatcgatcacttgccggttgccattgtggtggagcaaaaacgtatcgggaaaaacgctcgctcaactttagcaacttacacgggtatttactcactgttacggctgttgttttcgcgtgccggcaagccattcatcggctattcggacacattttcgtttaatttacctcaggggatgtgccccacctgccaaggcttaggttacgtggatgatattgacgtcagtaagttgattgatcccaataaatcgcttaaccaaggggcgatcacctttgtcagttttggaccggatacctggcgttggcggcgttatgcctacagcggattgtttgataatgacaaacccttacgtgactacacgcccgaagaaatgaaactgttgctttatgcaccccaacaaactctgaagcatgcaccggctaaatggccaagaacagcgctatatgaaggtgtcgtgcctcgcattaaacgatccattattggtaaaaaagaagcagaacatcataaggccgcactggcagaaatcgtaacgcgtaagccttgtccggattgccaagggacacgcctacgtccggaagtgttaacctgtttgattaatcaaaccaatattgcccaagtgctgcaaatggacttggtaaacgtacggcattttctgaaagccattcaagtgctgctggttcaggatgtgatccgggaattattacgcaaaattgatgcactgattgatattggcctcggctatctttctttagatcgacccaccgagacgctttccggtggtgaaacccaacggatcaaaatcgccaagtttctaaccagtgctttggtcgatatggtttacattctcgatgaaccaagtgttgggttacatcctcacgatatcgagctaatcaagcgggcactactgcggctcaaggaaaaaggcaacaccatcttgatcgttgagcataacccagcgctgattgcattaggcgactatattgttgaggtcggccccggtgctggcacaactggcggccacattacatttaccggcacttataagcagctgttgacgagtcaaaccttaaccgggcgtctgcttaaacagcgactgacatttcggcaaccgcgatcggctaaaacgaccatccatttgccgcatattacccgccacaaccttcaagatgtcgatgcggccatcccactgggcatcgaaacggttatctccggtgtggcaggttccggtaaaagtacgttagttgcggcgttacgtgatcatttaacggtgccgtacattgatctggcccaagcggatattggcgctaatatccgttcgacacccgtgacttatttgaaaatccttgatccaattcggaaagtatttgctcaagccaatcacgttggcagtagctggtttagctacaatggccgtggggcgtgtccacgctgcaaaggcaaaggggtcaccattactaacatggccttcatggatccggttgtttccgtttgcgaacagtgccatggcaaacgttacaacgatcaggcacttggatatacgtttcaaggcaaaaacatggcagatgttttagccatgccgattgccgcagctcagacattttttgcgcagaatcacgacattgccaagccgttagaaaatatggcgcgagttggccttgattacctcacgctcggtcagccgctgacgacattatctggtggggaaaaacaacgattgaagcttgcggtggaattaaaccgcactggcgaaatttacttattggacgaaccgactgccgggttgcatctacaagacgtcaccaaattactgcatttgtttgatgatttggtggcagcggggaactcactcatcattgttgagcataacttgcaagtcatcagtcaggccgattggctcattgacatgggaccggatgctggtatctatggcggtaagattctctatgctggcacgccgcaagctagtatggaggctaagcaatcgcgcaccggacaggctttgcggcaatataatgcagcaccggagcgtcagcccgattaatggcagcactttggcgcacttagcaggaagctcgcttgctatctgttcttggcctgctataatagcacttactggaattcgaccttcaaatcggatatctccagaatctgatgaaatgatggtgattgttttggacaattccaacacccgtgttgttgttggcatgtccggcggcgttgattcaagcgtcacggcattattgctgaagcaacaaggatatgatgttgtcggtgtcttcatgaaaaactgggatgacactgatgaaaatggtgtttgtacggccaccacggactatgaggatgttgctaaggtggctagtgagataggtattccttattattcgattaatttcgaaaaggaatactgggatcgcgtttttcaatacttccttgatgagtacaaagctgggcgcacaccaaacccggacgtgatgtgcaacaaggaaatcaagttcaaggcatttttggattatgccgagcagctaaatgcggattacattgcaatggggcactatgcgcaggttaaaaccgatgagcagggcgctgttcatatgttgcgaggcgcggacggtaataaggatcaaacgtacttcttaagtcagctttcccaggatcagctcaagaagtcgatgtttccaatcggtcatttgcagaagccggaagtgcgtaagattgccgaggcagctggattggcaactgccaagaagaaggactcaaccgggatttgctttatcggtgagcgtaacttcaaacaattcctgagcacctatctgcctgcccagcctggtaaaatgatgacggtcgatggcgttgagaaaggcacacacgatggcctgatgtattatacaatcggtcaacgtcaaggcttgggcatcggcggtaactcgcaaaactccgagccttggtttgtggttggcaaggatttagacaaaaacatcttgtatgttggtcaaggttttgacaacccagcgttgatggccacaagtctcagtgcatcgaatcttaattggaccaccggcgaggctccggctgatggcacgcatatgacagctaagtttcgttaccggcagcgtgataccggcgtgacgattcactatcatgatgacggaacggcgactgtcgactttgatgtaccggttcgggccattacgcccggtcaggcagtggtcttttatgatggcgaggagtgtttaggcggcggtacgattgatgcagcctatgcgcatactagtgagctgcagtatgtttagtgcgccagcaagttggcatgatgtgatgtaaggaagatcggtcccggagataaactttatctccggggccgttttgctttgtctggctgtttgggggtggggttattttgggttttataacgccgcggttggttggtcgggtttattctccgaaacgcgctcacagggccagaaacctgcacataaggaccttggacgcaatggccaaagcccggccatcacgtccaaggccgcttatgctccggtttctaagcggccctgttcgcgctctgtttccgaaacgcgctcacagggccagaaacctgcacataaggaccttgaacgcaatggccaaagccctgccatcacatccaaggccacttatgctccggtttctaagcggccctgttcgcgctcttgatattttgtccgaaaatactgataatgaaaaggttaagatgtgaaaaggggagcggcttgtgaccaagttatattttgtgcgccatggcaaaacagaatggaataatcagggacgttatcaaggtgcaaatggtgattcgccattattgccggagagttttgaacaaatcaaagcattggctgattatttgcgtggcatttcgtttgcgcatgcttatgtcagtccgctcaaacgtgcccgcgtcacggcccagacgcttattaaagacttaaatgaaccgattccgttgacgattatgccggctttgcgggagttcaatttagggaaaatggaagggatgacatttacggatgtcgctaagcattttcctcaggagttacatgcatttcggcatgaaccggcagcgtatgatccgcgtaaaattcacggtgaatcttttccacagttgattaatcgggccattccggcgattgtggctaccgtcgcgatggatcggaccggtacggctaatttgttatatgtcagccatggtgcggccttggcagcggttattcagagtctgcttggtacaccattggcagagattcgcaaagatggtgggctgacaaatagcagtgtgacgattctacaagcggatggtccgagtctgccatttaagttgctaaactggaatgaaacgagttttcttcccgagccaccgaagccaaccgacacgatttaatggttgcgactgcgatcatatcgcacactgaatgaagaggatgttatggattcaaatattttaaccgcatttaatcaaggaaaacacgaagaggcgattcaggcagccgttaaagcgattgatgctgatccgaaaaatcctaagcgttatgcggttttgacaacgatgctgattagtttgaaggccttggatcaagcaggtgagttattagccaaagcgcgggcactcttcccagatgacttggaattacagtacacagctggtctttttgcctatgagcaggcggattttccggcagcggctgcctggtttactaagtgtcgccaggatgatacgttaaaaaacgatgccacgtacatgctggcattgagctatcagcaagccggtcaacctaaaaaagcactggcctttgcattgacagcacacgaattggcaccgaagcaaacagatgcggcgttgctggcggcagatttgttattaggcgagcaagcttttgacgcggctgcggagattctgaagccgctgctggaagcgcggcaaccgcaagttttattcacgtacggcatggcgttgagtgctgcgggtaaagatggcagtgcctatttagatgcagccaaacagtttgatcctaaagggtacgatcaaaaagccggtaccgttgctgacatcaatcgcttcttacggttgcaggaagggggccatgatggacaggcatgaagatagcgttactggccgggtcaaaagtattttctttcagaatccgactaacttttttaaaatcctgctgattgatatcacggcaaccacgattacctggacggagcaggatattgtggtgaccggtacgttcggggatattaaagaagatgagacgtacacgtttaccgggcatgtcgtggaccatccgaaatatggccagcagtttcaagcggataattaccatgtggatcggcctacgaataaaacgggattgatcaattatcttagttccgacaagtttccgggaattggccccaaaacagcggagaaaatcattgacaagctcggagttgatgcgattgatcgtattttggatgaccctgagagcttaaaaggattggggatttcggcggccaagcagaagatgctggtcaccaatctgaagacgaaccagggaatggaacgggtcatcatcggccttaatgactacggcttcaccagtaacatggctggccgaatttatcagcaatatcaaaatgatgcgctggaagtcattaagcaaaatccgtatcagttaatcaatgatattgacggtatcgggtttacgcgggccgatcagattgccgccaagttagcgattgccccggattcgcaactgcggctcggcggtgcggttatggataccttacagcgtttgacagacggtgaaggcgacacttttgtcgagttaaaaacgttggtcacccagacgcttgatttactggagcgagcgcgtcaggttgcagtgaaccccgaagcagtcggccaggcaatcgtcactttagccaaggacaatgcgctggtagcggaaggtaagcgcatttttcctaaacgactttatgattccgaatggcagattgcccggcagttaaaaggactggcggatgccgggagcgctgccaagcaacctgcactggccgaaattaaacaaacattggccgccgtacaggaagagactggcattgcttatgatgaggtgcaaaaaaaggcgattatcactgccttgcagtcgccgatttttcttttaaccggcggccccggaaccggaaagacaacggtgacggacgggattgtccgcacttatgcgcaattgcatgatttatccttagatcgtcacgaatacacgccggacgatcctttcccgattatgctagcagcaccgactggccgggctgctaaacggatcagtgagacgacacagttaccggcaagcacgattcatcgactattgggattgggcgtggatacgcaggagtttgcgcctaatgatctcccggacggccttttaattattgatgaaatgtcgatggtcgacacgtatctttttcgaacgttattgacggcgctgcacccgggtatgcaaattgtgttggttggtgataaagatcagctgccaagtgtcggaccgggacaggtttttgctgatttgttacgcagccaggctttacctcacgcagcgttaacccacattcaccgccaggacgcggacagttcgattattccgttggcgcatgcggtcaatgccgggcgcttgccggatgacttcacccgcccgcaagtggatcggagctttttgccgtgctctcccagtcaagttccggaagtggtcgggcaggtggttcagcgtgccgcggttaaacagttttcgattgcggacattcaggtgcttgcgccaatgtatcgcggaactgcggggattgatcggttgaatccattgttgcaggatattttgaacccgaaacgcagcgctcggacaaaaaccgttcattttggcgaaaccgagtatcgaattggcgataaaattctccaattggtcaacgatccgaatcaaaatgtgtttaatggcgaaattggccagattgtcgggatcacacttgccaaagaggcggccagcaaaaccgatgagttgacgattgattttgacggcaatgaaataacgtataaacgcagcgacttcagcaaaatcaccttggcttatgcgacttcgattcacaaagcgcaaggtagcgagtttccaatggtgattttgccattaaccatgcagagtcgccggatgctgcgccggaacctactttatacggccattacccgggcaaaatcgtttttgattctggtgggcgagctcgctgcatttgagaccgcagttggcgaaattgcggtaaatcggcatacgggtttagtccagcggctgcaacaagcgtttggtatgaccgtttctcagccggacgtagaaaagccgacgcctgcaactgaagtcagccagaataccggacaaattgacactaacccgtctgacttggataatggaattagtactgacgaatcgaacaattatcagctaacccctgcattggtggcttcacagcggattgatcctatgattgggatgaatggtgtgacgccacaaatgtttatgacgaaggagaaataacctttatggaggacaacatacgcaagtcactgcaaattaaatcagtgacgcctaaggatcttgaacagttcaacgaccttttgacttatgtatttcaggtcacgcaaaaagatctggaacaatccgggtatgaagaaggggaacttgaacgggccaagcgtccggttttggaaaagtcggacgtattgggatggtttcatcaaaatgagctggtcagttcgctggcaatctatccgtgcaccgtcaatattcacggtaccttatatcagatggctggtttaaccggagtcggcacctatccggagtacgcggggcatggcttaatgcacgatttggtgaagttaggcttagagcacatgcggcaacataagcaatggatttcctatctgtacccgtatagtattccgttttatcggaaaaaaggctgggaaatcatgtctgatcatctgacgtttgatgtgaaggatacccagttgccgaaacaagtcgaggttccgggtcacgttgaacggctggagatagatgatcctgatgtgattgaaacttacaatcgctttgccatgaaaaatcacggtgccatgattcgcaatcagctaaactgggacgaatactggcgttgggaaaatgaagaagaacgaacagccggcgtgtattatgatgccaacgacgaacctcaaggctatgttttatactggattgccgatgaagtttttcacgtcaaagaaatgatttataccaatcaagaggcacgcgtgggtttgtggaattttatcagtgcccacttttcaatggtgacccacgttaagggcaatatctataaaaacgagccgttacattttcttctggacgatggcgatatttatcaaactatcaagccgtattatatggcgcgaattgtggacgttaaagcatttttggcacaatatccgtttgctgccgagaccacagaaccgtttcatttcgttgtaagtgatcccttggcgccgtggaataatgggacatttggcgtttattgggatgagcatcagcaggtaaaaattacgaaccgacctgttggcgaagcgattacgacggatattcaaaccttgaccacgatgttaatgagttaccggcgcccatcctatttagcccaaatcgagcgtttatctgctagcaaacatgcgatcaagttgttggagaatgcggtaccgatggaagaaccttatttttcagactatttctgatcggtatttcgaaaatttgtatgctgttgtcaaagcctgcacgtgatgggttttatgtgataaaagcgaaaaagcctcagactgatttttgtctgaaggcttttttaattggaaactatttaaaaaggttaaatactacggtcaatccaaaactgttgggaggccaccgaaaaatcaatttcaaacgggcgtgttcccatttcttcaccatccatttggccaaattccagtgaactggtttcaaccgtcaactttttagcgtgaaaaagatgtaccgcgcgacttgttggagccttgccacgcatgagttgaatcatcgcgaatgcccaggacacgatattaaaccattcgacaatgatcaaatcaagatgcccatcagtcgggtcggccggcttatagatttgaataccaccgccaaaataggggatgtttgtcgtcgtgcaaatataggcgcggtgaaaaaaatgccggacgcctttttcatacaccgcaaccggaaacgggcggcgggttagcaaactcccaataacgtgaaacaagtaagttaatttaccgagatgaaatttatttagcagctgtttactatcgctgtgattggctgcactgacaaccgctgcatcaaagccaatcccgatattattgacaaaataaccggtttcatcacgagtacgttcatgataacggccaatatcgattgcaaccggtttagtggcttgcagtacctgttctagcgcgtgcattggatcttccgacatcccgataccgcgagcaaaatcattacctgatccggccggtacataggcgacgggcagatcgtgctgccgggtaccgattaaaccgttgatggcttgatttaatgtgccatcgccgccgatcaccagtaaaatagcatggtcgcgggtattaaaattaccaatttgcttcgcgatgatattggtatgaccgggatagcgggaggttttgattgcataaggcaattggcgttgatctaagacggctttaacctgtttaaaaataggaattgctgctccgccacctgccgccgggttatagatgagataataaaaaacagccgccatcaactttcctcctaattagacacgcaatcaattataccgaaaaagccaagaaaaacaatattaccgtcatatttgaatagcatgttcgccaatagaagtaaacttaacttttcggcaaagccggcgtaacggtcagggggcctttcaaaaagattaacgtttaaatggcaggttaaaaattgcaaaaaaacaccgcacagcttatatggcaagtgcgatgtgagaataaacatttgagattgtgaaggctgctatagcagaatcagcatcggtagaataaccggatgacgttcggttttatcaaaaaggaattcctgcaagctgctggtaatcgcatccttcaaggtagcttcggtgaccttttcattatttgaaaaagttgatttgatagtgcgataaacccgccgctgagcctggttgatcagttccccggattcacgcatgtagataaagccgcgagagagtaaatcaggaccggccagcaccgcttgtttttgcatattgatcgttgcaaccacaacgaccaaaccttcttcggataacatgcggcgatcgcgaatcacggcattaccgatatcaccgacaccgctaccgtcaatgtagacgtcaccagcagggaagtgtccggcaattcgcgcacttttttcggttaacgccagcacgtcgccattttccatgatgaagcagtttttctctggaaccccgcattgttgggcgagttcgcagtgaattttttgcatccggtattcgccgtggcaagccatgaagaatttcggcttaatcagacgaagcattaatttttgatcttcttgaccaccatgtccggacgtgtggacgttgttgaccttgccgtgaatcacttctgcgccggcttcgcttaactggttgatcacgtgattgacgctgaccgtattgccgggaatcgggttgctggagaagatcaccgtatctcctggttgaatactgatctgccggtgagttccgttggcaattcgacttaacgcagccatcggttcaccttgcgagccagtacatagaatcattactttatcggctggcaatgaattcagttgatgtgcatccactaagacgtcatcgggaatattaaggtaacctaactcacggccattcaccattgccgtttccatagaccgtccgaaaaccgcaatcttgcggccatgtgccattgctgcatcggccgcttgagcgatccgtgaaatgttggaagcaaaagtggcaaaaatgatgcggccatcaatgcgatcgaaaatatgtcgaatcgatttgccgacgaaccgctctgattttgtaaaagtcggaatttcagcattggtcgagtcagacatcaagaccaaaacgccttcttcggcgaaccggcacattttttggaaattcggtgatggctgatccccaaccggagtcaaatcaaacttgaagtccccggtttggatgacaattccttgtggcgtatgcaccgcaatcccgagcgtatccgggatactgtgggtggtacggaaaaattcgacacttagctttttaaacttcaaaaccgtgtcttcgttgatttcagttaactttgtggtccgtaataacccatgttcttcaagtttgccgcgaatcaacgctgccgctaatgggccggcatagatgggaacgttgggcacttgctgaagaaaatagggaatcccgccgatatgatcttcgtggccgtgggtgatgaccaaagccttgatcttatctttgttttgaaccaaataagagtaatcggaaataacataatcaatcccaagtaaatcgtcttcggggaatttaatccctgcatcaatgacgatgatctcatcttggaattgaaccccgtacatgttcttcccgatttcacctaaaccgccgacagcaaagacggcggtttcgttttttttaatatttaatttcatatgattagaaagtggtcagcttgaaattggctgacttttcctcatactccaggaaatttccagaaagttcctgaataaattcaatgttgtaaggcgtgttggcttctacaagcgcacgcgcctcaaccgcagatggcgcctcgaggtaaagcgtctgagtggtttcccgtcgcggattttggatcttgtctttttgatataagactttgtagatcatgtttggactccttccgtggtacaaaaagaaaggaagtgcaacaaaacagcttccgaaaaaaaggacatgccatcaagatgacgaaccacaaaaagcatgggcgatcttgctggaatggccgatgtttcgtcgcttgaaccgcaaaatggcaacataacaccgttgccgtggtccatttcctgccacaactcctaaaacttttatgaccgatcgatttgttgtgaatacaacagctaggcatagtttagcatatttaatggagcgtgaacagcttacgagcatcacagacgtgcctgcgggagaatcaggtaattgtggcaagaaaagtttaacgtacttggtcgatacctcgatcttagctggatggccccggctgccaggttttatagtaccgaggagctgcccttttaagtagcaatggtgagttaattgctgaacttaggtataatgagaataggcacgttcgcagaatcagcgtgaaaggggtggatgccatggtgtggcttctgattgttgtactgcttgttgtgcttgccattctttggctattcagaaaacgttggcggcgaaacaaggcgattcagatcctgctctaccacagccaacgattaaccgatcaggcgatggcagaggcgttacagcagcttggcatctcaactgacaagccgatgacgtcaaagcccatcgccgatatttgggggcatggggtgatggcattttcatatcaaatttcgtcaagtctggggaaagtcacccagccggcacttgagcaagctttgcgccaagcagccaggcagttagacattgccagctcagacccggcattgccaccgtttgttttaaccgatttttttgaactcgaaggcgaattacatattgatgttgcctttattactaacgaggcaaccattgaatatgttcgcgacgttaatcgggtgtcgtcataggcagataaggagctcgcgcgatatgaatgatgatcaggacttaatcatgcgttaaatcaaaagctttgctcagggattaggcgctgctttaggcaaaaatcaacgcaaatcaaaccaacccgtgatcgtttttcacgaagcagaagtgagtctggccagttatcaaaaaacgctcatgaatgtgattcgcgaaaaagggttaatcgcggcccaagcacaattgaaaaagtggcaacagacaagattgtctgctcaccaatatcagcgtttaaatgcgtggattcaagaacagcagttaataaaaaatcgtaatccggacaagtaaaaaagcagcgagtcgttttataaggctcgctgcttcattatttaatggatcagaaccgcttccggatcaatcgagaagggatgttccttgttaatgtggtcatagaataaaacgccattgaggtggtcgatttcatgttgacaaacaattgccggatagtttttgagtcggacttttttgtgttcgccggcttcgttttggtaagcaatcgtaatgcgatcggcacggacaacgtaacccggaacatctttatcgaccgagagacaaccttcgccttcagccaatgcggcatgttgcacactgttactaataatccgcggattaattaaaacttctttgaagagaatttcatcgttgtctccaggaaccaagacagcggccattgctttactttgaccaacttgcggcgctgccaagccaacacccggacgcaaatgatatttctcgttttgctcttcgtcttgactgataaccaagtatgccatcatatcatgcgccaattgcttatcttcatcggaaagcggaaaagtaaccggtttggccctttctcgcaaaaccttagcgccgtcacgggtgatatccttcattaaatacacgatccgtacctccgttcatttcttctactagattagcacaggagcgaaaatgtgaaaagcgcgttattacgttagagggttggtaagcggggataaagcagcttttgtttcgccttcttactgcgtggcttgcgtgcagaaaaaacgtgtttgccagtgcagaagcctgtatataggggtcttgagtgcaatgggcaactcaagacggcttaacattctagcttacgcccataacactcttgacggcgcagaaaccggcaaatggggccttgagcgcaatggccaaacccgggcgacttatattctagcttatgcccataacgcgttcgcaggcgcagaagtctgcgtgtaagggccttggacgcaatggccaaacctggggaacttacattctagcttacgctcataacgcgctcgccagcccagaaacctgcacataaggaccttggtcgcaatggccaaacccgggcgacttatattctagcttacgctcataacgcgctcgccagcccagaaacctgcacataaggaccttggacgcaattggcaacccaaggcgacttacattctagcttatgcccataacgcgctcgccggcgcagaagtctgcgtgtaaggaccttggacgcaatggccaaagtacggccatcacatccaaggccgcttacactccgacttctaaccgcgccggctcgcgctcactttctgttagtattgacatcccacttttaatccgttattataaacaaggttcaacaaatacggtgctttccgttaggtgaggctcctatacgaacaatgctgctgctcagaaacatcgagagatgccaattgagtcaactgcgtctgcccattaaggcttacgctaatgcagctgaagctcgcttctaggcgtatagtgctaaaactaaacgattgggatgctttttctgcacgctctcaatcggcgtgcagtttttttgcttgatggaaagaaaaaaggtggtgagcataatggaacaatcttcaaagagtagtggtagtagtagcgatttagcagatcccggaaggcccattatgctgccactacgatctcttaagtgaaattaatggattcggcagcatcgcggctcttcccgggatacgggaaggagtttgtcgatgttgatgatggtatcaagcggtctgacacgctacgaagcgcagaaggcccaaaaaacaactaccatacgccaagaaacgatcagcaagacgaatctctttttgcccttgctgatgacattggctggtgtgagcagtttaatcttggttatgagccacagttggcttttaactgctattgttgcgattttggctagtttgacggtgatggtcattgcttatttggcaaaagcaatcacgcgccatcaaggtcagccgcagcagccagtgttggtcgtgcgtgacggattggttcgtcaagttcgcgcgcaagatctcgttgttggtgatgttttaatgctgacagcaggagaaaagctgccggttgatgttgcattagctcctggtgcatccgtaaccttgccacgtgacctggccgggctgctgattttgttaaatcggcgggtgccaaccggggtgggtattgccggtgctgtgatggcaaccgatacccaggcaacagtgaccgcagttttaaatgacggattgcttgatcatggactcaagcaattggctggacaatctgttacaacaacgccaacttcacttgtaacgagtgcggttgccggcatgaaattggtcttacaacagatttgccgaattttccgtctggctgtatcagttgcgtcacttgaaatgttaaaaaataagcaaatagaccgagacgagcagattcgggtagagatcgcatttgctcatcacgctaccttggttggggctatgaaacatcacagtaaaaccagtgattttcggcacaaccaagatccagtctcgtgaagcttggtcattaaattcaattatgaaagcatgcgcttgtgaaggcgcatgctttctttgtgttttagtttaacaagtattctgttatagtccattaagctttcgaataagtggcaatcttatcgcaagtcagttcttgctcaccttgaaataaaacgcttgcaacgagaattttgcaatgttacgctttctttgtaggagttttaattagtacagttttcctgagttaatgactacaggaatggaaagaggttctgattatggcaaaacagcatgctgcagttgattttaagcaactgttggacaatcaagatgccgattttaagcccacaatccaaattctggatgaagttggtaaagtcgtcaatcctgatattatgcccgatttgagtgatgatcagctggtcgatttgatgtcaaaaatggtttggcaacgcgtgctggatcaaagggcgacagcgttgaatcggcagggacgattaggcttttatgccccaagtgcaggcgaagaggccagcatgatcggtagtcacgctgctatgaagtcatcagattggctgcttccggcttaccgtgatttaccgcaattgattcaacacgggttaccgcttgacaaagcttttctctggtcgcgcggtcacgttgccggcaatgagtatccggaagattttcacgcattaccgccgcaaatcattattggtgcgcagtatgttcaaactgcgggtgttgcgctcggtttgaagaaaaatggcagtgatgaggtggccttcacctatacgggtgatggcggtacttcacaaggtgacttctatgaaggcgttaactttgctgggcatttcaaagcgccggcactgtttattgttcaggataacggctttgctatttccgtgccgcgggcgagtcagacggcagccaaaacgcttgcgcaaaaggcggttgcagccggtgttcccggcgtgcaggttgacgggatggacgctttggcagtctatgaagtcaccaaggaagcgcgtgcatgggcggctgctggcaatggaccggttttaatcgagacgttgacatatcggtatggcccacacacgctatcaggtgatgacccaactcgttatcgctccaaagagaccgatgagttatggcaaaaacgagatccgttaattcgaatgcgcaactatttgaccgataaaggcttgtggagcaaagacaaagaagatgccttgattgaaaaggtcaaggatgaaattaaagatgctatcaataaggccgataaagcgccgcagcagacggtatcgcgcttcttgaaagacacctatgaagttgccccgcaaaatgttgctgaacaactggcagaatttcaaggaaaggagtcgaagtaaccatggcacaaaaaacaatgatccaagccattaccgatgcgcttgatgttgagttggcgaacgaccctaagaccttggtattcggcgaagatgttggtaagaatggcggggttttccgggcaaccgatggcttacaggccaaacacggtgaggatcgtgttttcgatacaccattggcagaatcaggcattagcggtttggcaattggacttgccttgactggttggcggccaattccggaaattcagttctttggtttcgtttttgaaacgatggatagcattggcgggcaaatgtcacgtatgcgctatcggatgggcggaacacggtccatgccgattacgatccgggcaccgtttggcggtggcgtccatacaccggaaatgcatagtgataattttgaaggattgatcgctcaatttcctggtatgcgggttgttattccaagcaatccatatgacgccaaggggttactgatcagttcgattcgcagtaacgatccggttttgttcctggaacacatgaaactttatcgttcattccggcaagatgttccggatgggacttatacggttccactggacaaagcggcggttacccgcgaaggcactgatgtttcgattatcacgtatggtgcgatggttcgtgaagcgcttaaggcggctgataatctggctaaagatggtattaacgctgagattgtcgacttacgaacgatagcgccgcttgacgttgacacgatcattgcgtccgtcaaaaagacacacaaagcagtcgtggtccaggaagcacaacggatggcgggagttgccgccaatgttatcagtgaaatttccgagcgggccattttatcgcttgaggcaccgattggtcgggtcgcggctccagataccccattcccatttggacaagcggagaatatctggttaccaaatgctaaggatatcgaagctaaagttcgggaaactgtcaatttctagagagaagaggtgccaacatggcttttgaattcaaactgccagaacttggcgaaggtttggcagaaggcgagatcgttaagtgggacgtgaagccaggtgatgacatcaaggaggatgacaccctgcttgaagttcaaagtgataaaagtgtcgaggaaattccttcaccggtttcagggaaaattttgaagattttagtaccagaaggtgaaaccgcaactgttggcgaagcgctggttgatattgacgcaccggggcataatgatacgccggttgcatcgggtaccgctgcagcaccccaagccaatacggatacggctgcaccggccgcggcaccagctgctgccggatcagtaccggccatcaccgatccaaatcgggaaattctggcgatgccgtctgttcgccaatatgcacgcgaacaaggcattgatatttcacaagtgccagcaaccgggaagcatgggcgcattaccaaagccgatatcgatgcctttaaagcaggggcacctgctgcagcgcctgcgcagccagcagcaacctccgcgcctaaagcagcgcaaccagctccagcagcaacaccggcagcgccaaaaccgcagccagtcgcgccttacgtttcgaccggcagtgaagccgagctggagactcgcgagaagatgacgccaacgcgcaaggcaattgccaaggcaatgttagcctcgaaacaacggagcccgcatgtcacgagctttgacgaggttgaagtgtccaagttaatggcgcatcggaagaagtacaagcagtacgcggctgataaaggcattaaattaacgttcttgccatacatcgttaaagctttggtcacggtattgcgtgaatatccagaatttaatgcgtcaattgacgacaccaccgatgagattgtttacaaacattactttaatatcgggattgccacgaacacggatcatgggttatacgtgccggtcatcaagaatgctgatgccaagagcatgttcgaaattgccaaggaaatcagtgacaatgcacaaaaggcatatgacagcaagttgaagccagatgaaatgcgcggcggttccatgaccattagtaacgttggttcaattggtggcggctggttcacaccggtgatcaatcagccggaagttgccatccttggtgtcggtaaaattgctaaagagccatatgtcaacgctgataatgaaattgttgtcggtaacctgttgaagctgagcttgagttatgatcatcgcttgattgatggtgctttggcgcaaaccgcattgaatctcatggataaattgttagcagaccctgatctgctgttgatggagggataagcatggttgtaggcgattttgcaatcgatttggacaccgttgtgattggctctggctcaggtggttacgtagctgcgatccgagcagccgaaatgggtcagaaggtaactgttatcgagaataccttcattggcggggtttgtttgaatgttggctgtatcccatcaaaagctttgatcaatgccggtcaccgttatcaagatgccttggaagcaagcacgtttggtattaatgccaagggcgcggatcttgatttcaaaaaaacccaggattggaagcaaaacaaggttgtgcacacgttaaccagcggtgttgcgatgcttttaaaaaagcacaaaatcgaaaccatcatggggacggctttcttgaaagatgatcatagtctgcgggttatgcaaaaagactcggctcagacatacaccttcaagaatttgatcattgcaaccggaagccggccaattgaaatcaaaggcttcaaatttggcaaacggattttggattcaaccggtggcctaaacttaccggaagtaccaaaagaattcgtggtgattggcggtggctacatcggatccgaactggcgagcgcctatgccaacttaggcgcacatgtcacaattcttgaaggcaccagctcaattttgccaaactttgaaaaggatatggttcaactcgtcttgaactcctttaaaaagcgcggcgttacagtgattaccaacgcgatggcgaaggaagccgaagataccggcaatggcgtcaaggtaacctatacagcggacggtaaagaacaaaccattgccgcagattatgtgatggtcacagtcgggcggcggccaaataccgatgatttgggcttagacattgttggcattgaaacaacggatcgcggcttgatcaaagtcgatgcgcaaggacgaaccaataagcctaatatttttgcaatcggtgacattgttcccggtgctgcattagcgcataaagcaagttacgaaggtaagatagcggctgaggcgatcagtggcaaggcaagcgcggttgactataaagcaatgccggctgtttgtttcacggatccagaactggctacaactggcatgacgcttgctgaggccaaggataaaggcattaaagctaaagcaagcaagtttccatttgcggcgaatggccgtgctttaagtttggcgcaaaccgagggcttcgttcgtctggttacggatgaaaacggaaccgtcatcggtggtcaagttgctggtgccggtgccagtgatttgatctcagaattaacggtcgcggttgaaggtggacttaacgctgaagatttggctttgaccatccatccacatccgaccttaagtgaaaccattatggatgatgctgaagttgcattagggttgccaattaatatctagcaagtagattcatattgccaacatgatgcactgttaaggtgggtatcgacaactgattgtccgtgcccacttttttgatgggaaagcacaaagtcaaaaccgaaagtgcgagtgtaaggacttcatgaaaaaggaccaatatttcagttagttaacaattgcaaaaataaccctgtttaattttgtcttaagattgcgcttccgctaaaatatagataacgcagctgagaggaagggttttcatgcaaagagtcgtggtacatggtgccagcacggggacacaagggcttttacaaatgctgattatgtcattgcttgatttgcaagtcggctgttatgaacctgatgaaacattggttgacgtagccgggttgacggccttgagtcaaatttgtcacaatacgtttgtgaaggtgacgcccaaagttctaaaggcagccgatgttttgattctgactgatacagggacgccagcggatgaggggtttgtagccactaatattacggccattcggaaagtgctaaattcggcaatggcagcagggtttaagggtcgcattatcgttgccatgacccatgacgagcttttcacctatttcgctcaacgattttccggtttgaataagcgtcaggttgtcggtttaggtacttttggtgcaacctggcaatttgaacaatttctagcagagcggttggctgttcctgccgctcaagtgactgcctatgtggtcggaaccagtcagacgccggttctggtttggagccgagcctatgtaggtgccacgccggtgttgcgcctactggatgaccagacaattttttccgaggctgtgaaggcggttcagactttcttagccagtacgttgaccgtgatgcttggcaagttggttgaaccgatcctagctgcttttgccggtgatggggtgataggcacttttacccacttacgcgatgccgatgatggtacaggacagattagcagttcgccggttttattggatgaacgcggggtggtgacgttggcgatggtggcaggttccgatgatgaagaagctgccttaagccaagcgattcaagcagcccagacccagattgaagcgatcgaacaaggagcaaataagaatgaaagctaactatcattatcctttagatctcgattggaccacggcagaaaagatcaaagtgaccaccttttatgcactggtcgaggatgcttatgagcatggggttgatcgggataacctacttgctgcctataagggtttcaagcaggtcgtaccggataaaggaaccgagcgtcaactggggcgtgaatttgaaacactctctggttactcgatgtacacggtcgtacaaatggcacgccaaggtgtgagtcaaaagattagggtgagggtgagttaaacatgacacaagatccagaaaagatacgtgagacattgatcggttggtttgctgctagccggaaacgcattctgacagcaatggcacagccacttgatgttgcccaaaaaagcaatcgtaatgacctggtcaccaatgtcgataaagccaatcagcaatttttgattgaacatatcaagaccgattttccaacggcgcgaatcattggcgaggaaggccacggccatgatgatacggatcttaatgggttggtcttttttgtcgatccgattgatggcaccatgaattttgttaaacagcaggcacattttgcggtgatgatcggtgtctatcgtgatgggcaaccgattgtcggggctattatggatgtgatgcgcaatgaagtgttgagtggcggtccgaatctaccagtcacgtttgccggccgtcagttgaagccattgctggatctgccactgaaggacggtttgttgggagtggcaggacccatggctatcaagaatcgcttgcatttaggtgatgtggccttagctagttccggtgcgcggatgagtggtagtgccgggatggaatttattgaagtcgccttaggaaggcaagtcggctatgtttcctatctgcagccttgggatgttgcagcaggcatggcgattacgcaaggcttgggcgtcgaatttagtcgggaagacggttcggcaatcaacttaagtcagccaggcgttgtcgtggcagcgactccgcaagcacatcaaacgattctagccatgatggccggtaaaagtgaacaggcgcattaacgccgctcattaacgagcaacctcaaaaactggcggagacgattcccgtcagttttttgaatgtatggcctagatgcacggattccaaagaaaattccatcaaatcattcgcgtgaatcacttcacttttcagaaaactcacacagattgggtagaatgtgttataattcaaaatcgtataactgtgtcagttgctggcacttttttaatgcggtaagcggccagtagtgccagcagaaaggaagtagaaacgtgaaaacacgtgacgatattcgcaacattgcgatcattgcccacgttgaccatggtaagacaactttggttaacgagatgcttaaacaatcggatacacttgatcaacacattcaattacaagaccgggcgatggataccaacgccattgaaaaggaacgcggtattaccatccttagtaaaaatacggcggtgaaatacggcgacaccaccatcaacatcctcgataccccggggcatgctgactttggtggtgaagtagaacgggttatgaagatggttgacggcgttttgctcgttgtcgatgcattcgaaggcccaatgccgcaaacgcgttttgttttgaagaaggcgcttgaacagcatctaacaccgattgtggtcatcaataaagttgaccgtcctggtgcgcgtcctgaagaagtggtcgatgaagtgcttgaattgttcatcgaattgggtgccgatgatgcgcaattggaatttccagtagtttatgcttctgcggttaacgggacttcaagtatggattccgacttatcaacccaaaagcacacgatgaatccgctttttgataccatcatcaagacgattccagcgccaatcgataacagtgacgaaccattgcagtttcaggtggccatgttggattataacgattacgttggtcggatcgggattggccggattttccggggcaagatcaagatcggtgacaatgtaacggttatgaaactagacggttcacaaaagaatttccgggtcaccaagctctttggtttcttcggtttaacccggaccgaaatcaattctgctaaagccggtgacttgattgccgtttcagggatggatgacatctttgtcggcgaaaccgtgaccgctgcggatacgccagaagctttgccaattttacggattgacgaaccgactttgcagatgatgtttgtggctaatgacagtccttttgccggtcgtgaaggtaagaacgtaacggcgcggaaactagaggaacggttgaaggcacagctgcaaaccgatgtctcgttgcgtgttgacgatacggatcaagccggtgcctggatggtatccggtcgtggtgagctccatctttccatcttggttgaagagatgcggcgtgaaggctttgaattacagcttggccggccagaagttatctatcgcgatattgatggcgtgacgatggaaccgtttgaaacggtgcaaatcgatacccctgagcaatacaccggtacggttattgacgctatgagccaacgcaaaggcgaaatgcagaatatggaaaatgaaggcaacggtcaaacgcggctcactttccttgctccatcccgtggtttaatcggctattccaccgagttcctatcttctacaggcggttatggcatcatgaaccatacgtttgaaaagtatgcgccagtgatcaagaactgggaaccgggtcgtactcaaggcgcgttggtatctatcaatgccggcactgcgactacctacagtttgcaatccgttgaagatcgcggccaactcttcatcaatgctggcacggaagtttacgaaggcatgattgtcggtcaaaactctcgtgaaaacgacattgctgttaacgttactaagggtaagaacctgacaaacacccgtgctgccgggaaagaccatgcagctgccatcaagacgccaaagaagatgacgcttgaagagtcgattgagttcttaaacgatgatgaatattgcgaagtcaccccggaaaacattcgcctacgtaaaaagattttaaacaccggcgaacgtcaaaaggctgcaaagcgtaagaagattgctgcttctaaataatttttaaaaaagtcgtcaagttattggcggcttttttgatttcaaaaattaagccctcttcaaaaaatatcttaaccaccgtagacaatgaccttaatgataagcaatggcaactttgaggcttttttcaggactttttctgattaagacaaactaaacttcctgatacattccagcagcagtgcgatgggtcaccttgttcgaatattaagatagaaagcaagagctggcggagcggtggcgggctcagtggtgaaattggtcttaagcggagtgggcttctccgctttagaccaaggccgagcttcgaaaccgcggtctttgcgggttcgaagtcgtgcccaccactctagctgcgcggtcgccagccgccaccaccgcggagccagctcggagtaacggaaatcacttaattagagtagaaccgagaaaaagttgacacttaccgattgccagtgcggcttggcggtacgagccggtatgctataattaacccaatcattgcttgaaaggccgcgttttcctaatgaaaaaaatacgccatgtggattatttcatcttggtgccgtatctgattttgtgtgcgattgggatcgtcatggtttattctgccagcgcctattgggtacaacgtcaatatggcgccgccgaaactaaatacttagttcagcagattctttttgtgattcttggcatcggaacggtattcttcttttataagatgtcactcaagattttacgtaatcgctgggtgctttttattttgatgagtaccttgctggtgttgttggtttatttgatcctgcatggtcgtgcggtcaatggggcatcggcctggattacgattggcggttttcgattacagccatccgagtttgccaaaatgattttgattttttatttagcgcacatgttgtcatcgcgtgaaaacagtttccagcaagaaaatttccggttacaccaaatgtggcagccgctgtttatggccggcgtcatcatgtttttggttttcattgagccggacactggcggatttgcgattctcttcttgattaccttggtcgttgtgatgtcaagcgggattcccatgcgttatggactgctctgggtgttggggttgattgcaaccggcgtcttagggtactacattgtgtcacattaccattttgccggtcttgaaaataactatgcctaccagcgactggtagcggcgattcacccgtttgagaaagccaatgctgcgggtaatcaggtggtcaattctctttacgcgatcaatcatggcggctggttcggagtcggcttgggaatgagcagccaaaagctgggttatctgccggagccatatactgacttcattttggcagtgattgccgaagagctcggattggttggaaccgtggtcatcttaagcttattatttttcttagtgatgcggtttttcttaatcggggttcggtctaaaaatacgtatcacaccctgattgcttatggcattgcgacgatgatgctggtgcaaaccattttcaacgtgggtgcagtggcaggcgttatccccgtgaccggtgtgacattgccatttattagttacggcggatcgagtatgatcgttttatccatggcagtagggattatgcttaatattagttatcacagcgaacgtacgcaacgaaaggtagagaagacgcatgcataaagttttagtcgcaaatcggggcgaaattgctattcggattttccgtgcctgtgaagaactgggcctaaaaaccgtgggcatttatgccaaagaagatgctttgtcgattcatcgctttaaggcccaggaaagttatcaggtgggagcaggtaaggcgccgatcgctgcgtatttggatatggatgacattatccggatcgctaagcaaagcggggcggatacaatccatcccggttatggtttgctttccgaaaatgccacctttgcgcgaaaagtacgtgcggccgggctgacgtttgttggaccgcgctcggaactattggatgtgtttggcgataaggtagcggctaaggaagctgcccacaaggctgggttaacgaccattccgggaacaccggagccaacgcgtgattttaccgaaattcaggattttacggctaagcacggcttcccggttatgttaaaagcggcaagcggcggcggtggtaaaggcatgcgaatcgtacattctgaatccgaattagaagccgtttaccaaaatgcggtcaatgaagctaaggcaagttttggcgatgatcggatgtatgttgaaaaatatattgcgtccgccaaacacgttgaggtacaagttctgggcgatgaacatgggcatctattgcacctttttgaacgtgattgttcggttcagcgccggcagcaaaaagttgttgaaattgcccctgctgtggctctgccgttagcattaagaaaccgtatctgtcaaagcgccgttgatttaatggccagtctgcattatgaaaatgccggcactgtcgaatttttggtcgatggcgatcagtattactttattgaagttaatccacgtgtgcaggtggaacataccatcacggaattgattaccggggtcgatattgttcagtcccaattgcgcattgctgccggggccgatttatttgcggacctgcacttaccacagcaagatgcgttacgggaaaatggggcggctattcagtgccgcattacgactgaagatccagaaaataacttcatgcctgacaccggcacgattaatacttatcggtcaccaggcggctttggcatccggcttgatgttggtaatgcctatgcgggtgccgttgtcagtccatattttgattcgttactggttaaggcaagtgtccacgcacctagttttcctgctgcagtggctaagatgcagcgcgcgttacatgagtttcaaattaccggcgtcaagaccaacgtcgcctttttggaacatttactggcaactcagacattccggaccggtgaggcagaaacggcctttattgatgcgcatccggaattattacaagtgcaagcgaaaccagatattgcatcccggttgctttggtatatcagcgatgtaaccgtcaacggctttaaaggcgttgaacgtcaaagccaaaagtactatccggagttgcaatatacacgccattttgctgctgctaaaccgcagacggatttggtggccctacttaaaaatgaaggtgcccaggcggttacggattgggtcaaggctcatccagcgctgcttttaaccgatacgactttccgcgatgcccatcaaagtctgtttgcaacgcgaatgcggacccgcgatatgttaacggtcgccgaggatatgggaaacggcttgcctaatctcttctcaatggaagtttggggcggcgcaacttttgatgtggcttaccgctttttgaatgaagatccgtgggtgcgcttaaagaagttgcgggctgctttaccgcacaccttgttacaaatgctttttcggggtagcaacgcggtcggatatcaaaattatcccgacaatgttattaaggccttcattaaccaggcagcaaatgacggtgtggatgtctttcggatctttgatagtttgaattggctgccgcagatgactttgagtattgatacggttaagcaggctggcaagattgccgaagcgaccatgtgttataccggggatattttaagtgacgcccatccgaaatatcagttggcatattatgtcgacttagctaagcagttagttgatgccggggcggacatgattgccattaaagatatggcgggactactcaagccacaagctgcgactgaattgatcgcggcacttaaggatgcggtgacagttccgatccatttgcatacgcacgatacaaccggtaatgggattgcaacttatctggctgctaccaatgccggcgtggatattgtggatgtggcgcaaagcagcttttccgggacaaccagtcagccgagtctggaaagcctgtattacgcgttgagtggcaatcaacgtcagccggaagtcgcgatcgaaaaggcgcaattgttgaatcgatattttcaagcgattcgtccgtattatgcggacttcagtaatggtgtgaccggtccgttaaccgatatttacactgtccagatgccaggcggtcaatatagcaatttacaacagcaagcacacagcatgggcattacggattttgaggcagttaaagccatgtatgcgcaagtcaatacgctgtttggcgacattatcaaggtgacgccttcgtcaaaagtcgttggggatatggcattgtttatgttacaaaatcatttgaccccgcaagatgttaaggaacacggagagcaatacgattttcctgcttcagtcgtggcttttttcaagggcgacttagggcagccggtcggtggttttcctaaagccttacaagaaaagattctaaaaggacaaaagccgttaaccgtgcgtcccggacaattagccaagccggttgattttgcggcggtgcgacaggatttaatcgcggcaggtgtgccggatccaagtaccgaagatattttaagtgctgttttgtatcctgatgttttcaaggcttatgcacgcaagcaaaagcaaatcgggccggtgaccaaattggattcaccttcctattttcaaggtatgcgcctaggtgaaacggtggaggtcccaattcgggccggcaagacattgattattcaactaaacgccattggcaaagcggacgccagtggaatgaagacattgtactttaccgttgatgggcagaaacaggaaattcagatccgcgacgctcatcaaaagagtgccggcttgcagcatcagttggccgaaccgaccgataagaatcaaatcggggccccaatggccggaaaaattgtttcggttgccattaagcaaggacagcatgtggccaaaggtgaggctttgtttgtcattgaagcgatgaaaatggaaacaacggtgcacgcaccattttccggaacagtgacccatctgtatgtagaagcaggcgcattaatcaagagtcaggaactgttggctaaactgcaacccggggccgccaagcagtgagtttagaaggtgagaacatgtttgcaatgaaacagcggcaaggtttagtcgtttgggtctattcactcaagcaattaaagaccttgcgccgttatggcaccattatgtacgtttcgcggcggttaaaatacgtttatttatatctggatcgggatgaaattgcagcaacgagtcacaagcttataaaattgcggttcgttaaacgcgttgaaccatcacatcggcctgagttgaaaacagagttcggtgatgaaattggcaaattcaagccgactgaggaagatttggaaaccaaggcgaaaccccaacgacatgccagacttttaaccggcgaggcaaaaggtgatcaacatgcgcgtcattagcggtacatttcggggattacgcttaaatgcggtgccgggtaatcaaacgcggccaaccgccgataaggtaaaggaatcgatgtttaacatgcttggcccttattttgatggtgggcatgcactggatttatatgctggcaccggagcgcttggcatcgaggccgtatcacgggggttaacggatgcagttttggtggatcggcaatatgcagcgatcaagaccattcacaccaatgttgccctgactaaacaggcagagcgctttacggttttgaaaatgtccgtgacgaaagcgattagccattttgcggccaatcaccagcagtttgatcttattttgatggatccgccgtatgcccagcagcatgttctcgcacaattagctgcgtttgtcagcgaacaattagtggtaccaggcgggcgggtgttggttgaaaccggcttggatgttgattatcctgaggtcatccccggatataccaaaatacggcgtcagacctatggcgttgcgcaggtgcttattttagagcgaaacgaggaagaccatgactaagaaaattgcagtatttcccggcagctttgacccgtttacaaatggccatttagacacggtattacgtgccagtcgcttatttgatgaggtggtcgttgcggcgatgacgaacaccagtaaacgtgcgctgttttccagtgatgaaaaactcgcgctgatcgaggccagtaccgctgatatagcgaatgttaaggcagttgcggccccaagacggttgacagttgaatttgcccggtcaattggcgcacggtttatcatccgcggcattcgcaatgttgccgattttggttacgaagctgatattgccacagttaatcatgacttggatcaggaaattgaaactgtctttttgctggcggacaagcagtacgatgccttgtctagtacgattattaaggaggtcgcggcgtttggaggcgacatccatcgattcgtaccggcaccggttgaaaaggccttatatgcgaaactaggtgagtctcatcaagcaaagtaatcatttgaagcccaaaaaacgttggcggtggctagttggcgcgattattgccatcatcttgatcgctgcgtttttattcttccccaccaattattatttggaagtacccggttccgccgaatccttaaaaccgtttgtcaaagtcgccggcaccaaagataaagccaagggaagctacatgctgacgacggtcggtgttgtgggcccggcttcacctgcgttattacttttcagcaaaacccaggcgcatactgagattgtgtccaagcaggatttaatgggtagtgacagcagtgccgaatacgatcagttgcagacttactatatgaaaagtgcggccaataacgcggtagcagctgcgtttaaagccgcaaaacaaccggtcaaaaccgagcatcgcggtatctatgtgatgtccgtattgccacaatcaccatttaaaggcaaactagccctcggagacacgatcacaaaattgaatggcaagtcttatcaaacggcggatgcgtatgtcaaggccatcaagtcaaaaaaagttggcacgaatatcacgttaacctaccaacataagggccaaacgaaacaggcaaccgctaaattaattcgtctaccgcagaccaaacgagcgggtattggcattactttaactgagaatacggcggtgaccagcgatcctaaagtgacgattgatgcgggaaacatcggcggtcctagtgccggcaccatgtttgctttgcagatttatacgcaaatcacccaccaggatttacgtcggggtcgaatcatcgcggggaccggtacgattgatccagatggtcatgtcggtcagattggcgggattgataagaaagttgttgccgcggatgcaaaaggtgccaagattttctttgccccgaatcaaccggccacaaaaaagttgaagcattacgatcctaattatgtcaacaactacgccgaggcggtccagaccgcaaagcaaatcaagaccaaaatgaaaattgtgccagtcaaaacgctcggtgacgtcattcgttatatgaaagcttatgccaaagctgaccagtaagtggttagtggttgtaataagttcaatttaaagaggaactgttgaaaaaatagttctttttgtttgccctgcgtaatgtgttgttgaggtgagaaaaatggcgacactgacttattggctgaaaacatattggtatgcacccttgattattttaatcggcggtttctttttttggcagcaggcgaaggcaggatcggcaaatcagcctttgtcggtgagtgtgaattcccatagcagttcgcacatggcggcgtcacgatctagtagggcaacaagcatgagtggcagtcatcgtccgagccacggtttcgtgcatttaaaaggcgcaatacaacatcccggcatttatccggtcaaagaaaacacgcgctgggatgaagtggttaaagctgccggcgggttgacggcagcggctgatattcaacaagtcaatctagccaagatcgccagtgatcaggaaagcctatatgtcccggaaaaaggcgaaacgtcaactgcaacggcaccacctaccacggcaggcggcacttctgctactgggaagcccgcccagactgccagtggtgccgttgttgatcttaataaagcggatgtggcgcaactgacgaccatcagtgggattggccccaaaaaggctgcggatattattagttatcgcgacagccatggtgggttcaaggatattaacgaactcaaagaagttcatggtattggggataagacttttgaaaccctggcgccgcagctaaccgtgggcccatgagcgggcggttaatcttacttgcgactgctttacttgccggcatcatgggcggtatcggtttgtggtgggtgctggctatcttgcttatttgtcttgtcatgaaaaccaatcgaaccagtttcgtttatgttggcctttttttaatcattggctgggggtgcggaagggcagatgccaatcaatggcagaatccgccgcaaccccgtggtagtgtgaccatcccggcgtcagccattaagcttaaagacgggtatgtcagctttatcggtcgggctgccaacgggattgccgtcagtggtcgtggttcggtctcaaaggaacttgcggaacggttggctagtaatgatcagccggtacaattggccggtggttatgaagtagcacgtttggcacccgcacgtaatcagtttgaatttgattatgcaacttatgcgtggcaaagccggcagcttgcctatgaattagtcaaaccgactttgaacttttcttttcaaccacgaagacaattttttgatgtcgttgatagttggcgcgtccatctgtttgcctatttcgaacaattaccgaacaaggtacgccaatatgccaaagggttgcttttagggcaattggatgatgattttttaacgcaacgccaagcatttgttgatttaggcgtctttcatcttttttcgatttccggattgcatctgttcgccttggttgccgcgctttattggttggcagcaaggttacggataccgcaaggattagtcgatggcctgctattgggattgttgccactattcttattattgctgccattaggtgcgggcttgtggcgggcggtatggatgcggttagctggcattattaatcgttatcttcggtttggcttaaccgggctggatctgtttagtatggtgttgatggtcaacttgctctggcaaccgcgtgtcttgatgaccatgggtgggcaattgacgtacttgatgaccgggttgctcattggtttaccggcgctgcataagtggcaggtgaattggcggttagtattaggcggcatgcctgtcattgcctggcatacgttcagctttaatcttttgacggtattcttcaattggcttctcatgccgatttttgaactgatcattatgccggggttggtatttgccttattgatgccgcacgcagggttaacatatttgtttaacgatgcattgcaattattggagaccatcctcattcgactgagtcacctgcctgggcagattattatcggtgcgtttcccagctggttggctgtgctgggggtttttgttatgatgctggttttgacgtggcaatgttggcccgtagcagttggctggtttgtagtacttgccttgtggagttggtatcagccgaattatcgggtggtgatgtttgacgtgggtcaaggcgatgcgattttgatcgaatccccgtttcatcaaggggttatgttgattgatacgggtggccgcatattcggcaaaaccagccatcctcctgttagccgcgcgattgtcccatatttgcatgcacgcggatatgcccgcttgaatacgctggttttaactcatcctgatatggatcacgttggcgatgcacctaaacttgctgagttgataccgattgagcggctagtaaccaccccaaccgcgcagcatcatcctatgattaaaaaagttagccagcgggttgccgcaacgcaaacagtcacagcggatcaatggctgcaggtcgggccacttcgattacaggtacttgcgccaagtgccacgagccatcacgacccccaggatacaaacgcggattccattgttctctatggtaaaataggtagcagtcgctggttatttactggggatgctgaccaaaccgttgaaaaaacgcaaattctgccgcgacatttgcaagtcgactatttaaaggcaggacaccatggttcaaaaaccgccagtgcaccggcgttaatttcgagtttacagttaaaagccgctttaatttccgctggtgtcgataatcgatatggtcatccgcatccagaaacattggcaacgtttgctaatgcccatgttccatgggtcagtaccagtgaacaagggatgctttgggtggaaccaaacccgcaacgtcaacaggatcagctatttggctggttgcagaaaaggagcaaacaatcgcatgcaggtccgtgattttatcaaacatcttaaaaatggcgaacgaccgccgctgacattaattcttggcgaggagcaggctttacggcaacaggctcaacaagcgctggctaatttgattcctgaagaccaaaaggccatgaattttggccgttatgacatgcatcaaactccagtgggcgttgccttggatgatgcgacttcaattccttttttcggcgaataccgcgaagttgtgattgacgatccttactttttaaccggcgaaaaaagtaccgataagattgaacatgatctcaccggactgcaggcttattttgacaatccggttccgtcaacgatgatggtgttaatcgcaccgtataaaaaacttgatgaacgtaaacggctgacgaaagctttgaagaaggcagctttgattgttgatgctgcgccactggatgaacggtcagcgcgaatggcattggcacaaatcttcaagcaacatcaagtcgatattcagccaccagcactcgatgcgcttgttcagcgaacgaacggacagtattcggtcatgatgggcgaagtccggaagcttctgacgtatgcaagtgatggtagtccattaaccgttgctgcggtatcggcattggtccccaagcagcttaatgatcgggtttttgatctggtaacggatgtgttacgtcaaaatgccgcggatgctttggcactttatcgtgatctgcttgcacaacgcgaagaaccgattcggctcaatgcgttaatgctaggccaatttcgacttttaattcaggttaagttattagcacaaaaaggttacggtcaaggtgatattgctgctacgctcaaggcccatccgtaccgagtcaaattagcgttacggcaggttggtcgcttgccttatcaccaactggcccaggcttatagtgggctggtggatactgaaaccgcgatgaagacgggaacgattgataaggcactggcctttgaactgttcatgctgaagtacacaggtcaagcgtcagcgcatcggaaggggaagtatacggcttcacgctcctaaaactgagatggtcaatgatgtgcgggtgtgcttagccgatgacaacaaaaaataacccttgtggacgaaatatcgtcacacaagggttattaaagttggcataacgccttgattacttgttaagtagggctgcaagacggctcttgtcgcgaccggccttgttcttcttgatcaggcctttgctgttagccatgtcgatggcacgagttgccgctttataaagatcctgactgttgtcagcattttgttcgcttgcactcttgaacttcttaacagcggtacgcattgcgttcagctgggcaatgttacgttcacgggcattttcctgcgtcttaacgcgtttgattgcagatttgatttgtggcatgagatgttcacctccaacagtggattatgataaaactgcataagtttcaacaaacgctattatacagaagccagagcggcaatgcaataaaaagttgtaaaggaaaattgcttgatagctaaaattacttgcaatcagtggcagacttcggtaaagtatgaaggtacttttgaacctgatacttagtttagcgaaccaccgacgctttactcagtttcaggcaatattctgaaaggtggtacaacacaatggcaattgaccaaacgcaaaagaacgaaattatcaagcaatacgcacgacacgatggtgacactggttcaccggaagttcagatcgcagttttaactgctgaaattctggctttgaacgaccatttatccgttcacaagaaggatcatcatagttatgtcggtctgatgaagaagatcggccaccgtcgtaatctgcttgcctatctgcgcaataaagacatcattcgctaccgtgacttaatcaagtcattaggtctgcgtcgttaatcacgtttaacaaaggtcgccgcggcggcctttttgcgtgtttttatattaatagcgggcatcagctagtggtaaaaggccaaaaagacagttccaacttacaggagggatcagctaatgtatccagaatatcggcagcgttatcagggtcagttagtacgcgtcaccattttaagcgtaacgacaacggttgcttgggtgattggcacgattggctcacagtgggcagttgccggtgtgagccgtcatgatgaaaaacaggcgtcctcggaacaagttgatccggtactcgtcgaattggtccgcgttatcgcaggtcgcttagtccacaaaaatttagcgacgacctcattgccggaatcattgctgccaatggtgacggcactgaccgagcatcactggcgggagccggatccggaatcggcgttaaagttgattccaaagccggcaggggcaccgctggacttctggtcatggcgcaaggcggttttcttgacggttccccagcaaaaagttcgaccagctgatttgcatgagtggcttcggaacattttgccgaatgtccatgggttaggatacgggccggtgacagatctggctgccttagctgttttagcgctggataccagtcaccaccttgctgctggcagttcacctgaagtagcggtggtgctggataacggaaaagaagttgctgcgtatcatctggatgccgctcaaacaagcgataccgggtatcaaagtgcacttaaagcggccaaacaaaatctgaaaaccgtgcatcgcttttttgcaaacgaggtgtaactgcgcctccgcgttttaaggtgatatggtagttggaattttaattgtctgatagagcatgttgagctaacgttgtcgtttggatattaagtccacgttctccatccagtgaccattttcgggggcactggatggatttttttatagcattcaacgccaaccatttgccgcctgaaattcggctctataggttttcgccttatcgtgtggtacacttgtatcagaatttattcggcggaggtatgcggcaatcgattgtcggcaaccatacttccataaattaaccacgaggtgaaaccatgacgaagatcaatctggtcgctcttggtggggtacgtgagaatggaaaaaacatgtacgccgtcgaagttgacgaccaaatttttgtatgcgattttgggttgaaataccctgataatgaattacttgggattgatgttgtgatcccggactttagctatttgactgaaaatgccgaccgaattgccggaatctttctaagtcacggccatgcggatgcagtaggagccttaccttattttcttgtggatcatccagttccggtttttggttcggaattgacgattgcaatggccaaggtcttcatgcagcatgacagcaaagccaagaagtttaaagactttcatgttattgatgaaaagtcggtcattgactttggtgatgtgtcggtatcgttctttaaaacaacgcatagcattccaggctcgttaggtatcgatattgaaaccagcgaaggccagattgtgtataccggcgactttaagtttgatcctagcgctaccccgatgtatcaaacggattgggcgcgattggcacaaatcggtaataagaaagtgctggcgttgttatctgattcagccaatgcagagtcgccttatccgaatgccaacgaacatgaaatttatgaccatatcaaagaaacttttgaataccaagatggccgaattatcgtggcaggtgttgccagcaacattcagcgtattcaacaggtgattaatgccgctgcatcgcttgggcggcgggttgtcttgaccggccgtgatgtcgaaaaggtcgttaaaaccgccattcgtatgggttacattaaattgccggatgatgacattttagctaaaaccaaagagctaaaaggcctggcaccggaaaagaccgtcattcttgaaaccggtcggatgggtgagccgatgaagtcattgcaacgaatggcaacatcccgtcatcgcctgattcacatccatgaaggtgatcttgttttcattaccaccacgattgcccatgcgatggaaactatggcggctcgaacgaaagacatgatttatcgtgcaggcggggatgtcaaagtcttaggcgacgatattcactcttccggccacgcttataagaatgatttgcaactgatgatcgatttactcaagccagaatatttggtaccggtacaaggcgaatatcgcttacttgcagcccacgcggaaattgcgcatgaagctggcattccgttagctaacatctttattgtcgggatgggcgatattttgcggtacgaaaaaggccagatgaacgcctccggtcatgtcaacgccggcaataccatgattgatggcattggcgttggcgatatcggcaatattgttttacgtgatcgcaaaatgctggccgaagatggcattttcattgcggttgtcaccattgaccgtaagaaaaagcgcgttgtttccaagcccaaagtcacaagtcgcgggtttgtttatcttaaaaccagtcgtgacttattggccgaaagcggcaccttggtaacggagacggtacaaaagaatctggataacaaagaatttgactggacccatttgaaacaagatgttcgagataaactcagccgcttcttattcgaacagacaaagcggcgtcctgtcattttgccggtcatcatggaaattaatcaaaacagtgcaaaacggcaataaacaacaaaaaattcggatcattttccgaatttttttattgtcattgcaatatctgaataaaacaacgacaggaggaaggcatgaccaatatggtatcattacccgacaatgagcaacgtcacctgacaatcggcaaacaggcgctgcaaaagggtaactatgcttcggcggcggcgcatttagaaaaggcgtatgaagcaaagcaaacttttgcaatcgcccagccattagcggctagtttaaatgggcttaaacagtttcatgaaagtctcaatgtgatgttggcgcattaccagtcgtttatgcaaacagacggtgatgtccaactggttttggatgcttggcttggtacgcttaactttgtcatggcgcgaacgatgctgcggcaacttgatccgattcggcgccagcgttttcgccagcaaattgaggcggcagaagctttagccttgaatgaacggagcgaacaaattgcggaactggttcgcaaagtcagccatctggggggcttttcccggcaggagcagcaggatctgtttagtcaggtggggttattgccaaaagcacaactcatcaaagcggcggttcccgacttgatcgacgaatcgattccagtggcgatgcgcctgtcattgttagaccttttaacgaatgttggctatgatcaaccggtgcaatatcaggcttatgatcgagtcgaaaccattattccgagtgagttacccggcatggcggatgagccaaccgggccacagattctggatcgactgcaaaaagcattaggcgatgacgatcaggagctggggcaagctttgatccaaatggcgcgggtacagattgcctttttatatccggatatcagtcggctaattcctgaccaagcggcatttgttcaagcttatcttgatcatcatcaggggaaaaccaccgcgtttgacgatctttttgcttggcaagcggctgaaacagcgaaattgtccgaataggcgtgatgacacgttttcactgtaaatgaaagaaacttgacggtagctgtttacaaagtgaaaatgaccatgtatactcattgctggaattcatttccagcgtagatatttgttttggtatttacgctcaaatgtagtacacttaaacgtaaaggattatcagggtacacaaacaaggtatcctgtattcttacgaaaaatacaggaggttcgttttttcatggctgaaaaagaacactatgaacgcacaaagccccacgtaaacattggtacgatcgggcacgttgaccacggtaaaactactttgaccgcggctatcaccaaggtattgtcggagaaaggccttgcccaagcgcaggactatgcttcgattgatgctgctccagaagaaaaagaacgtggtatcaccatcaacaccgcccacgttgaatatgaaacggaaaagcgccactacgcacatatcgatgcgccagggcatgccgactacgttaagaacatgatcaccggtgctgcccagatggacggtgcgattctggtcgttgctgcaactgatggcccaatgccacaaacacgtgaacatattctgttggcgcgtcaggttggtgttgattacatcgttgttttcttgaacaagactgatttggttgatgatccagaattgatcgacttggttgaaatggaagttcgggaattgctcagcgaatacgattatcctggtgatgatattcctgttctccgcggttctgccttgaaagcacttgaaggcgatcctgaacaggaaaaggttatcatggaattgatggataccatcgatgaatatatcccaaccccagttcgtgaaaccgacaagcctttcttgatgcctgttgaagatgtcttcaccattactggtcgtggtaccgttgcttcaggtcgtatcgatcgtggtacggttaaggtcggcgatgaagttgaaatcatcggtttgaagccagatgttctcaagtccaccgttaccggtcttgaaatgttccgtaagaccttggatcttggtgaagccggcgataacgttggtgtcctgcttcgtgggatcaaccgtgaccaagttgaacgtggccaagttttggcaaagccaggttcaatccaattgcacaacaagttcaagggtgaagtttatatcttgacaaaagaagaaggtggccgtcatacgccattcttctccaactatcgtccgcagttctacttccacaccaccgatgttaccggtgtgattgaattgccagatggcgttgaaatggttatgcctggcgataacgttactttcgaagttgacctgatcgctccggttgctatcgaaaaaggtaccaagttcaccgttcgtgaaggtggccgtactgttggtgccggcgttgtttccgaaattcttgactaatttctgaataaacgtttaaaagtctgcaagcttgcttgcaggctttttttgtgagcgcgagccggcgcggttagaagccggagtgtaagcggccttagccgtgatggctggtctttggccattgcggctaaggtccttacacgcagacttctgcgccggggaacacgttatgggagtaagctggaacatatgaggcataatggccgggctttggccattgcgcctcagggtctttacacgcagacttctgcgctggggaacgcgttatagaaagtgagcgcgagccggtgatgattacagggttgcgtgtcaggtcaataataatggataaggaatgaataatcgcaggtattttacgtttcaagattttgacgcttgaacagccttgggaaatcaaagattattttatcgaatcatgacaccaaaaaatctcaagtcgtgtttggcttgagattttttgggctattttcagcagggattaggtaaaccaagtaactgcaaaacattagccgctctgagtgatcaaggaagggatttaaaattaagctgactgtttaatttcgcttggctgtgtcactgtaatcttggttttagctggttcaattttgtccgcttccagaatgatgttaccgatcgattgtactcggatgttgccgctgcttggattcttgacgctgacaatatcggaacaaatatcggcattgatattggtgctgtattcaaagaccaaatcggaatgaagcagtgcgcagtttttcattgttaaatgatcaacataacataacccctgattgctctcgattgtacaattgataagcgtcagattttttgtattccagcctagataagcaccattaatagtggaatcatagatagtaatgttctcacagttccaaaatgcatctttggttacaagcgtggaatgatgaatttcaacatttttagcaccatcaaaggcgtaatcaccaatcaaatcgaggtggtcggcgacaatgtttgtgctattcataccaaaatagttcccatttgcttgcacatggtcgagtctaatgtgattgcagttccacaaactttcactggcatcggaaaaaatgaacgttttttaggcgaatattctggctacggcgaaaagtttttggtgcttgaattgtactatcggacatagtgatgtcattcgtataccagatgcctgaccgcgccatggtttcgaagatggtgttagacatcgtgatgtgctggctgtaccaaagtggatacttatattgaaaaattgactgatctagtttaatattgcgactttccttcagaggagattcaccttttccaaaagtcgttttgacaatggtggcattttcctgaccaaacagagaacgttcaccatgaaaaaattgattgttgtaactcaccataaaagattcgcttctttctatatgttctcgaaaaatggtcgctacttccaaaactttgattgcagctgttacgctacgatgtcatggagaagttcagcagccttaccagataaataaatggtatttgactcatgcaaactgtctctagcagattgagaggtattgatgacaatttttggacagtttaatcgaaaactggtggcaggacggcgcgtgccaatgattaacaagaggtccgcttgtgcgagcatttgctgaccatattttatttcgtctgggtaggttgccaggtgtcttaaaacgaagtcaggtaaaatcagtccgccacaattggggcaagtcggcacagtgctggttgacggtttttgccagtcataagaatgatgacaaatcgtgcagtgattatgccggacatcgtcccagtattcggcaacatgacgggttccggctgtttgatggagatagtcaacattcatcgtcaccacaccaagcagcttgttagcctgttcgagctgcactaacgcttgatgggctctgttgggtaacgcttccggctgacagaacgtctggcggtatagctggtagaaagcggacgggtcggcgctgacttcttctggatcaagaaaacgaaatacgtcaccagcaaatttgtgtgatttttttaagatttgatcaatcccgttcaaatctggaatgccagattctgtggagataccggcaccagtgaaggcaacgatttggtgatgttggcgaataagggttgctgcctgctgtaaacgttgtgcttgtttcaagggactcatctggtttcgaaaacgtgccgggcaaccgttaagccatttagtacccgaggaaagccaatataaggaatgcagtgaatcatcgtttcgacaacttcggttttagtcagaccgacattgagtgcaccattgagatgaacctgtagttggtcggcggtatcgccttggataagcagcgcggtcacggtgatcatttcccgctgttttagatccaagccgggacggttgtaaatatcgctaaaagcaaattccaaaatatatttaccaacatcaggcgcaatgtcggctaacgaatgcataacgttggccgcagcctcaccgtcaacttgggcaagcgtctcctgaccattttctaatcgtgttttttctgacatgttcatgacctctttcatttaggatagcttcactctaaatgctggagttaactccatgtcaatcacttttttgaattttctgtggttaatttggcttttagctgatgataggtcgtgattttgttttctaaaaatgcaatatgggcatcaatttcccggcgttgtgccgctaaccgggatttttgcgtgaagagtaacttcagacgttcgtcaatggtgctattgccttgataacgtaaacgggcataagttttgatttccttgatgggcatgccagttgcttttagccgcttgatgaatgcaatccagcgctgatcagcatctgagtaggtccgtcgattattttgatcgcggtcgggaataatcaagtgttctttttcgtagtatcgcaacgtatcaattgacagtgaaaccaattttgaaaatttaccaattgggtagcccatcaacgaagccttctttcttaggttatgttgggttgtatgatgagactttctgtgaaattagtcaatacttatacaagaggctaagcgttttaatcgctaaactaaaactattgttatatgataaagtctcggaaaagggggccattcatttgacgaaatcaacaacttggcggatgatcgcatttttctggcatcagctggcagatatgaaacgtcaattgttccgtattattgcggcattggtaggggtggcggtggcttcgtatctggtgccgcgattaacgcaatatgtcattgatcaggtcattccgcaacgtgcgatgggaacactaatgggcgtgattgcgatggcgctcttgctgacggctatggctgggtggttaagcggtcttagtacttattggatcggtcaggtgagtttgcatgcaattgcccgcatgcgcgatgacttgtttcgccatacgctgggattagatatgcggtattttgaaacgagtcaaacgggtgatttgatggtggtgctcacgagtgacgtcaatacgttacagcgtttaatatcgagcaatacattgggtctatttggcagcttactcagttttgtcgtcgtactggtgctgatgatcgttcaggactggcaactgaccgggctgattttattaacttttccggttttgtttattctgaataatattttcgttcgcaacattcgtgctgcttatcggcgggtgcgggcaagctctggcatgatgaataatcaaattcaacaggctttgacgagtatcgggctgattaaaagctttacgaccgaagccacaacggcaaggacctttcaacaagccaatgcacgtaaccgcgattatcaacttaaagcgaccaaactcagcgcgactttttcaccgctaaccgatttcgtcaattatttgggaacggcaattattttaggctttggtgcgattcaggtgatgcatggtcagtttacgattggcttgatcgtcgcttatactgcctatcttggcattttgcaggcgcccattcgccaactgaccgggttgattcaacaattacagcaggcaacggtttcgtttgaacggattgaagcattgcaggcagcgactccgcaaattgtttcgccgccaaatgctgtccacttgccgcgatttcagaaacgaatccagtttgatcacgtagatttcagttacgatgaggctgtgccagtactgcaggatgtcgactttaccatcgaaaaagaagaagtcgtggcactggttgggtcgtcaggcgccggaaaaacaacgattacaaatttattggcgcggttttacgatcccactagtgggcgtattttgatggatggcatcgatttgcgtcaggcggatctgatgagtttacggcaacaaattgccattgtctcgcaagatgtgatcttgcttgatggcaccattcagcagaaccttgaatatggcacatcatctgccagtgaggcggccatttggcaagcagcagaggccgctaacattgcagcttttatccgcagtttgcctcaaggactggcgacgcaggtaggtgagcgcggaattcggttatcaggcgggcaaaagcagcgcatcgcaatcgcgcgagttttcttgaaaaatgcgccgatcgtcatccttgatgaagcaaccgccgcattggataatgagtcggagcgttttgtgcaaaccagttttgatcggctaatgactgaccggacatcgatcgttatcgcgcaccggctttccaccgtgcggcacgcggataagattcttgtattagcacatgggcgaattgttgaagcggggaatcacgagcagttaatggcccaaaacggacgctacaaggaactctatgatttacagtttacgtgattgctgttgttgcgattgttattcttaggttcatgcgcagtttgtgaaaatcagaaaaaatcaagttgcgacaaggctttttttgtcacaacgtttactttcccaccggtttcgggtatcatacattaagtatgcaatgtgaattgcgagactaattgtcggaggtacagcatgtctgcaaaatgggaaaaaaagggcaccaatgatggtgaactcacctttgaaatcgatttaccaaaaattcaagaaggcttagaccaggcgtttcaacgtgttcgtaagaacctgaccgtccctggatttcggaagggcaaagttagccggaccgttttcaaacggatgtatggtgatgccgcgttatatgaagacgccttgaacatcttgttaccagatgcttatgaagcagcggttaaggaatccggtattgacccggttgaccaaccaaaaattgacgttgagtccatggacgaaggcaagccttgggtgatcaaggctaacgtaacggttaagccagaagttaaacttggccaatacaagggcgttgaagtgcctaagcaagacgttgaagtatctgacgacgacgttaacgctgaattggaaaagcgccgcgaacaacaagccgaactcgtggttaaagacgacaaggcagctgaaaatggtgataccgttgtgattgattacgtcggcaccattgatggcaaagaatttgacggcggttcttccaagaactatagtttggaactcggctcaaattcatttatccctggctttgaagaacaattggtcggccataaatctggcgatgaagtaaccgtcaatgttacgttcccagaagactacaaggcaaccgatcttgctggtaaagcagctgaattcaaaaccaccattcatgaagttaaggtcaaggaattgccagaattagacgatgactttgccaaggatcttgatgatgatgtcgatacattggctgagttaaaagacaagatcaagaaagaattgaccgatcagcgtaaagaagcggccaagaatgcggttcaggaagcggccatcaagaaggctaccgagaacgcaacgatcgaagaagtgccaaatgcgatgattgaacaagaagtgcataatcaaatggatcaatacctaggcaatatgcaacgccaaggtatcagtcctaagatgtactatcaattgaccggtacgactgaagaagatctgcataaacagtttgaagccgatgcagaaactcgggttcgtactaacttggttcttgaagccatcgttaaggcagaagatattcagccaactgaagatcaagtgaccgaagaagttaagaatttagcttccgaatacaacatggatgaaaaagccgttcgtcaggcattgagtgaagatatgctcaagcacgatattggggttaaagaagccatcgacatcattactgacaatgccaaagaggttgaagcggccaaggatgaaacagctgataaggctgattctgacaagaagtcagctaaatagttgtcacaatcgcgtcaaagagacgatccttgatcgtctcttttgtcgtcttaacaggtccaaaaagccgaacagatcccttgacattggcatagcggttagttgctagtcggtacttgacggttctggtagaatgaaggtaacaagaaagggttgaattagatgtttgacaacgttgaaacaacgggtccggtgacttgctctttttgtggcaagtctcaggatcaagtgaagaaaatcgttgctggccctggggtttatatttgtaatgaatgtatcgacctctgcaaagagatcattgacgaagaatttaaagaagaagcctatcagaatctgctcgaagtccctaagccaatcgaaatcatgaaatcacttaatgattacgtgattgggcaggatgctgcgaaaaaagcactttcggttgccgtttataatcactacaagcgcgttaaccagatgcagactgcgacaaaagacgatactgaactccaaaagagtaacatcgcactgatcggcccaaccggttcagggaaaacattcttggcgcagactttagccaagatcctgaatgtgccatttgccattgcggacgcgacaacgttaacagaagctggttatgtgggcgaagacgtcgagaacattttgcttaaattgctgcaaaatgctgattacgatgttgagcgcgctgaaaagggtatcgtttacattgacgaaattgacaagatcgccaagaaagccgagaacgtttcgattacccgtgatgtttccggtgaaggcgttcagcaagctttgttgaagatcttggaaggtacgattgccaatgttccgccacagggtggacgtaaacatccgcaacaggagtttatccaaatcgataccaccaatattctctttattgtcggcggtgcctttgacggtattgaaaatattgtcaagaaccggattggcgaaaagacgattggctttggtaccgactccaccaatcaagtggatccggataagtcactgatgcagcagattattccggaagacctcatgcaatttggaattattcctgagttcatcggccgaattccgattttggcagcattggagaagctcaacgaaagcgacttggttcggattttaaccgaaccgaagaatgcgttggttaagcagtatcagaagttgttaagtctcgatgatacggatcttgaattcacacctaacgcattgaaggccattgcccatcaagcgattgtacgtgacactggggcgcgtggcttgcgctctatcatggaagccatcatgcaagacaccatgtttgacttacctagtcgcagcgatgtcgacaaggtagtcgtcacaaagtctgctgttgaaggcaaggctaaaccacaattagtgcttaccaagggccgtgaagcctcctaaagcaagcagggtttcaaagagcaccaggttggataacctggtgctctttgtttgggctcaaccatgaataaagatttgtaaattcctgctagcggcccagtcagcttttaaaatatgctaaactattgaaggcagtggtgcttgagtgccactaaaagagatgaataaaaaaggaggccgtttaagatggacgtccatgatgtcaaactgacaatcagtgcggttgcggctgcgcaatatccagaagatggccgtccggagatcgcctttctcggacgcagtaatgttggcaaatcttcactgatcaataagttaattaagcgtaaggcgatggctagaacatccagcgttccggggaaaacccagacgcttaatttttacgatcttgatagtcgcctgttttttgttgacgttcccggttatgggtatgccaaggtcagcaaatcagctcgggcaaagtttgcagcgatgatcgagacctatcttacgacgcgacaaccattacgtggggttgtcttgctggtggatagtcgtcatgagccaaccgccgacgatatcagtatgtatcaatatttaaagtattatcagctcaggactttagtggtcgccacgaaaatcgacaaaacgcctaaaagtaaacggctgcatgttgttaagcaaattaatcaacggttggatttaaaccagactgacacggttattccgttttccgcagtcaccggtgaaggctatgatgcgatttggtcttggttgagtcagacttcgggagtgggggaaaatgaataatgaactttaatgaatatcaacagaaggctaaccgcacattggctggcaacgaacatgtgttaaccaacttatcgctaggcttggcaagtgaaagcggcgaagcaattgacttgattaaaaagtacacctttcagggtcaggatttagataaggttaaattacagcacgaattaggggatgtgctgtggtatctttctcaaattgcattgtgggctgacattgactttgatgatgttgccgctggtaatattaaggcattggcaaaacgctatccgcaatccaaaaagtgaacttagcaccattcagaacatatttaaacgcagctaatgatttagcgtctaaaaaagcgacctccgaaaaattttcggcagtcgcttttctgtttgcttgagtatggaaatcagcataaatggttactttactttttcggctttttagcgctatctttatcagactttttcgtcatcttttcgtgatgttttggatctggcccggtagcttgttctttatcgctgggaatgcttgcgaatttatcgaacatgtcgtttaggttggtttgagtgttgatcttaagtgccatgcacggccacccctttccttggagaaagtatagcatcaaccagcattagcgtctagactgacaaccggtttttctaatgccgatatttggccaaaggttgatcttgaaaacgatttaagaactaggccgtgtttttcgatgattttacgagttaaaaaaagagtcaccaaaatatgaatatttattgcataaaaattgaattacgtgtatagtacattcttgtaatcaaggagggtattatgacgcatttgaaacgttggttaatcgctttggtcgcagtttttgccgcaattgtgaccttaaatatgcaaactgtccaggcagatgacagcctggcaaagattcaacaaaaaggcacgattgtgatgggcactagccctgattatgcaccatacgagtttttggtgaataaaaatggcaagaatcaggttgtcggcatggatgtcgaagttgcccgcaaaattgccaaggatcttggggtcaagttagtcatcaagcagatgaatttcagctcgttgctagtggcgctgcaatccggcaaggttgatatggtgctggctgccatgtcaccgactaatgctcgccgcaagtcaattgatttctccaagacgtattataaatcgggtcaggatattctgattaataagacggatgctaagatttacaaagaccacaagagttttgccaataagaaagtcggcgttcaaaacggtagtctgcaggagaccttagcaaaaacccaaatgaagtccagtacgactttaggactgacaaaagtaaccgatttgattctggcgctaaaaacccacaaagtcgccggggttgtcgcggaaggtgcggttgctgaggcctatacgtctaacgatgataaattggttgaaattcccggtcattttaatctgtcaagtgacacgatggggactgctatcgggtttgccaaaggatctgattctttagtcgcagcggccaataagagcttagcagatattaaacaaaagaatttaatcccgcaatatctgaaaaccgctggcagttacatgaagacgaataccgaagataccagtatgctgcactattggacttatttccttaaaggggttgagtatactttactcatcagtgcgattggggcgttctttggggtcttacttggtacgatctttgctttattgcggttgagtaagcatcgattgccacatctcattggggttgcctacatcgagttcgtccgtggtacgccgttgatgattcaggtcatgtttgtctacttcggtattggcattttcattgatattccagcgctagtagcagggttgatcgcggtatcgcttaattcagctgcatacgttgccgagattatccgtagtgggattgatagcatcccgattggtcagactgaagcggcccgttcgctgggcttatccgagcgccaaacgatgaccagcgttgtgttaccgcaagccatcaagaacatttggccagcgttaggaaacgagtttatctcactgattaaggaaagttccattgtttcgatcattggggttacggacttgatctatcaattaacggtggttcaaaccgcaacttataaaggtgttcagccgattctgatcgcaatggtcttatattttgttttgacattcgggctatccaagctcctgagtcactttgaaaggaagatgaatcatgcagcataaacctttgatccaaatcaaccacttgaccaagaagtttggcgataatgtggtcttgaatgatattagcgaaacgattgaccaaggcgatgtgattgtcgtgatcggtgcgtcaggtggcgggaaaagtaccttcctgcgcagtttaaatctgttgaaccgtccaactgcaggcgaaatcctttttgaaggaacaaacctggttgatcttagcgaaaagcagttggataatgtccgggagaaaatggggatggtgttccagagcttcaatctttttccgaatatgacggttctagaaaacatcaagctggcgccgttaaaagtcaaaacggtgacggatgaagaagcaaccaaaacagccaaggaactgttggaacaagttggcttggcggaaaaagccgatgcctatcctgctagcctctccggtggtcaacaacagcgggtggcgattgcccgcgcgctggcgatgcaccctgatgtgatgctctttgacgaaccaacgagtgcattggatccggaaatggttggtgaagttttgaaggtcatgcaggatcttgccaaaaccggaatgacgatggtcgtggtgacgcacgaaatgggatttgcccgcagtgtggccgaccaagtctggtttatggatggcgggaagattcttgaaaaaggcacgcctgaacagcttttcgaacatcctcaagaagagcggacacaagactttctttctaagattctcgcacaataattttcatcaaagtactttgtctggcacatactgggcaaggtgctttttttgtgaaatcgagctggtggggtatcatgaggtttgaggcagaagtacaggctagatgtgacaagcatgctggcatgtgtataggctatctgcttgcaatcgtattttagaatctttataatgttaggcgaacatttgttttataaggagcttacaatggcatctgcacacattgaacataagttatcgttactgccggatcttcctggtagctaccaaatgaaagacatcaacgggaagattatttatgtcggcaaagccaaaaatctcaagaatcgggttcgatcctactttaagagttcgcatgacggaaaagtagcggcaatggtggcacaagtggcggattttgactacattgtgacctctacgaataaagaggcgttcttgcttgagattacgttgattcaaaagtaccaaccttattacaatatcaagctgaaaaaggggactggttacccttatatcaagatcaccaatgaacgcgaccccaagattgaaattaccgggacgattcgcaaagacggcggctactattttggcccttatcccaatgtttacgctgcccaggaaaccatgcactttattcaaaaagtgtatccactacgccgctgtaacggctatcagggtcgcccgtgtctttattaccatatggggcagtgtctcggcgcttgttttcgcaccgtcccggagaaggaatataccgatcagattgcgcgaattaaacgctttttgaacggtaatgtcagcaaggccaaggccagtttgactgccaaaatggagcgcgcggcaaagaatctgcaatttgaacgggcagccgagattcgggatcaactttattacattgagcaaacggttgagaagcaaaagattatttcgacggataataccacgcgcgacttgtttaatttttatatggataaaggctggatcagcattcaggtcttctttattcgccaggcgcgattgatgaagcgtgagtcgcgcttgtttccggtggtcaatacggctaaagaagagtttgaatcttttatcttacaattctacagccggaaaaataacgttaaaccgcgtgaagtattggtgcctgcagggctcgataataaggtgctagccgatatccttgaagtaccggtgcgcacaccccaacgaggcgaaaaacgcgagctgatggcgctagcagccaagaacagcaagattaaactggaagataagtttcggttaatggaattagataatcgaacaacggtaggggcgatgaaagagctgatggcagccttaaagttaccgatgggccatgtagtagaagcatttgaccatagtcatatccaaggtgccgatccggtgtctgccatggttcaatttgtcgatggccaacctgctaaaaacaattatcgcaaatacaagttggatgcggacaaaacccataatggtgctgacgaagctgccaatacgcgcgaagtcattcgccggcgatatacgcggctgctaaaggaacatgcggcattgccggacttgattctgatggacggcggtgagattgaaatgaacgcggctaaagatgtcctggaaaatgaattgaatctcgatattccggttgccggaatggtcaagaacaataagcataagacggctgccttgctattcggtcacgccgacgagatgatcaatctggatccgaagtcgcagggcttctacctgttggaacggattcaggatgaagtgcaccggtttgccatcacgttccatcgccagcttcacgccaaaaactcgttggcatcgcgccttgagggaattaagggcgtcggacccaagacacgcttaaagttgctgcgtaaattcaagaccatcacaaagatcaaagaagcaccattggaagatattcaggagctaggcatttcaaaacgcgtcgcccaggcactgaagctttcgttaacggcagatcccacgccggcacgtcgggtataaatgatgcggataacgtggtaattttttagagccgttttcaagacaatggaaaaagcaggttccaaaagacaaacgttgccttttgatgcctgcttttttacaagattattgagaaccgaaaaccgaatttaaaaagcgtcattcaaacgcacaaaaaaactcgcagcgcattttcaaagctgcgagtttttaatttaagccatgaccactatcaagtgacgcttacaagcttatcttgacttagcgattctctttagcaactggacgccagaagccaagaatcagtgcggcgatgatggtcccgataatcaatgacatgataaagccaaatttctgatcggttagtaagagtgcaacgacaccgccatgaggagccggaacattaacgtgccagagctgagttaaaccaccggcaatcgcagaaccgattacggagctaccgatgatgtgcaatggatcggtggctgcaaacggaatcgcaccttcagtaatgaacgttaaaccaagcgcatagttagataagccggcattgcgttcctgtagggtgaatttcttcgggaagaaagtggaagcaaccgcgatagccaatggtggaatcataccgccgatcataacggcagccatccagcgaccatctttaaagccagatgcttgataaacgccaattgcaaacgtataggccgctttgttgaaaggaccacccatatcgatactcatcatggcggctaggatgacgccaatgagaatggcattgccagtacctaaaccttcaaggaagttaatgagtgcaccgttgatcgctgcaaaaatcgggttgataatgaagaacattaacagccccataatcgcaagaccgatgaccggataaaggagaatggtccgcataccgtctaatgagcgcggcatcttagccaatgcttttttaagacccacgatcatccagccggcagcaaacccggcaaccagaccgccaaggaagccggccgggttttgcgctttcacaaccgatgccgaggcaacggttgccatataaccaccgacaaacccaggcatcaaggcagggcgatcaccgatagattcggcaatataagcagctaataccgggaccaagaaactaaaagcaaaagaacccagattattcgtgaacgtgaaccacatagaggtcttacccagccattgttccaggatgaatgagatcgccatgataatcccgccgccaacaacgaatggtaacatgttggagacaccattcatgaggtctttataaatgcgattccagagggtgccgccggaagtctcttcactttcactggtttcggtgttggcttcaccagcagcgtgaaagacttggccttgacctttaagggtttcttcgatcagttcttgcggtttcttaatgccatcaatgacagggcgattcagcaatttcttgccattaaaccgatccatcgcaacttttttgtctgcggcaacgatgacaccggccgcacggttgatgtcagcatcggttagcttgtgcttgatgccttcagagccgttggtttcgactttaatatcaacgcccattttctcggcagtttcttttaaagctgcttcggccatgtacgtatgggcgattccagttgggcaggcagtaacggcaacgataaatggccgttctttgcgcttttcgtctttaaactcagcttgcttagcggctttgtccttggcttcttgggctttttccgcttcttcttcagctttgtccttggctgctttttccgcttgtgcttttccaaaaagatcgatgacttcatcaggggttttagcctgctttaagtcagcgaccagttttggattgatcaaaagtgaagacaaggcagctagagcagctaagtgttcgttattggcgccttcgggagcggcaatcatgaagaacaagtgcacgggctggccgtctaatgcgttaaagtcaacgcctttggtacttttggcaaacagaaccgttgcccgggtaaccgcgctgtctttggcatgcggcatcgcaatgccttcaccgattccggtagttgattctgattcacgctttaaaatgtcattgcgatattcgtcagcgtcagtcacaatgccttccgcgtggtatttagcaaccatttcatcaatcacggcctctttggtggtgcctttgaggtccatgatcatgacattttttagtagtaagtcacgaatgtccattttgtcctcctaaacttctttaatgttaatcgtctgcttgacggcagcgatcttatcggcagtggcaagatcctcagaaaaagcagttgcagaaccgcatgcgattccaaccttaaagctttccagaacatcatgtgtttgcgcaaaagttccggtgaaacccgctaacatactgtcgcctgcaccgaccgagttcacagcaggttgctttggtacgttaccgaaccaggcatgatcctgctcaatcatgagggcaccaccgcctgccatcgagatcaaaacatgttgtgcgcctaaatcaagtaagcggcgaccggctttgataattgcctcatgactggtatatggtgcgtcattgaacagagcagctaattcatggtgatttggtttcacaacaaggggatgatcgggaagggtatccagtagtgcctgaccggtggtgtcaatcacgaagtctgcgtcatgcgcatgaattaaggggataaggtcccgataaaatgtgcttggtaatcctttaggcaaacttccggacataataacgacatcacctgattttaggttggccagcttagctttaaagtcggcaatttcggtctcgctgatagcagggccgctggcgttgagttcggtttccgattctgctttgagcttgacgttaatccgggtatcacctttgacttttgtaaaatcgcaaggcatggcaagcgcgtctaacttatcttgaataaacgtcccggtgaatccgccaaggaatccccaggcagttgtgggcaagccgagtgtttgtaatatacgactcacattgatgccttttccacctggcaatttaacgtcgtgggccaaacgattgacagcgccaaggttaagccgaggcaactcaatgacataatcaatcgaagggttgagcgtaactgagtagatcaagaatgaacctccttaatattttgatacctttgatagctcgctggaagcccttgtagtgaactggtcaggatggttgcatcgccaatatcggcgaatttgacgaaactgacctgttcgaacttacttggatctgcgagaatgatcggttgacgcgcttggtgaatggccaagcgcttgatcacggcttcttccggatcgggtgtggtgttcccaaattcagggtgaataccatttgtaccgataaaggcgatatcgaaacgataatgatgaagtgcttccgcagtcgttgcgccaatcagcgccttggttgctgacttgaccataccgccaagcattaaggtcggaatttgataatcagctaacaatgaggcattatcaaccccggtcgtaataaccgtgaccccaagatcggccaaaaaaggaatcaactgggcagtggtcgtcccggcatccaaaaagaccagatcgtcttgttcaacttggcgagcagcggcatgagcaatggtttgttttgcccgtaagttttgcgttgacttacttgccacgtccggttcatcgccaagaccgttgacacgtttggccccgccatggatccgtttaagttcgccggctgcttcaagttcatccagatcgcgacgaatggttgattccgatgcatccaacgcggccattaacgctttagatttaatgacggtatgttgttgcaattgagcaaggatgtattgtcgccgttcttctgtaagcactttcgtttcacctcgtccttcattatactgatgaaacgttcaaaatcaacctaaaaccgttaaaaacattcactgctgtcacaattcgaaccttttcattttgctttacatttttacgatattgttgcgcttgaagtgtgagtccttgtcttggacgtgttaaaatgaaaaaggcatctgatttactatgcgaacagcgcgataacgcgtataattaaaaattatgttttttcagaaaggggatcgccaatgtttgtcgatcaggtacaagtagaagttcaggcgggcaaaggcggtgatggcatggtcgcgtttcggcgcgagaagttcgtgccgtttggcggaccagccggtggtgacggcggccgcggtggcagcattattttatatgttgatgaaggcttacgaaccttaatggattttcgctatcaacggcactttaaagcgccagccgggggtaacggccaaggcaagtcgatgtatggtcgcgccgccgaagatcgccgaattgccgtaccagctgggacaacggtcacggacgctgatactggtgaagtcctcggcgatcttactgcaccggggcaagagttggtcgtggcaaaaggcggtcggggtggacgcggcaacattcactttgtctcgcctaaaaataccgctccggaaattgcggaaaacggtgaacccggccagcatcggtttattaagctggaattgaaagtgctggctgacgtcggtttggttggctttccgtctgtcggtaagtccaccttgttgtcggtggtaacccaagctaagcctaaaattgctgcctatcagtttacaacgctcgttcccaatttgggaatggtgcagttggatgatggcaccgattttgtaatggctgatttgccgggtttgattgagggcgcttcacagggtgttggcttaggcatccaatttttgcgccatgttgaacggactcgggtcttgttgcacctagttgagatggatccggaaaatggccgtgagccgctggaagattatgatcaaatccgtaaagaattaggcgcttatgacgaaaatatcttaaagcgtcctgaactgattgttgccaccaagatggatttgcggggtgcagcggaacggtttgccagctttaaggcagctttagttgatcgcggcattgatccggctaatatttttgaaatttcaagcctgacccaccgcggcgtcatgcctttgatgcataaaaccgcaacagtcttgaagacggcgccgcaattcgagccaaaacaggaaccggttcaatcgaccgagtacaagtacacgccggaaccagcattgaaagtgacgcgtgatagtgacggtacctttgttctaaccggcgagaaggtggagcgggcatttaaaatggccaatcttgatcatgaagacggcgtcatgcggtttgcacgccaattacggagcatgggcgttgacgatgccttgcgtgaggccggtgcacaaagcggcgatttagtcgctattgatgattttacttttgagtttgttgaataatcttcgagcagcatgttgtaaagaattaattttataaagaatggtggggcctcaagtgaaacagacgcgcaaacgaaagcgtcggtatatccatggattcgacgggttacggacaattggtgttattggtgttattttatatcatttacgtcctgaactttttaggggcggatatctgggcgtcccaattttcatggtagtttccggttatttaattacggatggcctcctgatagaatttgaccgctatcggcacattgactttaaaagtttttttattcgccgatttaagcgactttatccggcgcttaccaccgtgttgtttggtacggcggcctatattacgcttttctcgcagaatctattgcataacctgcatatgatggttctgacaaacctgttatacgtttataactggtggcagattttaaatggacaatcctatttcgcccgctatgcgaatggagaatcgccgtttacgcacttgtggacgctctcaatagaaggtcagtattatcttatttggccgtttttggttctgggcttactattgttggttaaaaatcggcatcagattgccaatattgtcctgattctggcagctgttagcggcgcgtggatggcgatcttgtacatgatgacggttgcccacacatcgccagcggcttttgacccaagtcggctttactacgggacggatacccgtgcgttttccattctattcggtgcggcacttgcctttatttggccgagcagtcggttatcgacgcatttaccccgcaaatgggtttttagcctcgatctaatcggaacggtgagccttgttgggttactgacgatggttttcacggtcgatgcccagagtagttttctttatgaagggggcatggtccttttctccattttgacaacgattttggttgcagtggttgcgcatccggccgcacattttgatcgcttgttgacgaacccgctgtttagttatatcggcagtcgcagttatggtctttatctctatcaatttccggtcatgatcttctgggagaatcgtttccgcaacattgccgatcatccggttttatatcctgtgattgaagtgattttgattgttctgattacagagatttcttatcggttgattgagcagccggccgcgcattttgattatcataaaacctgggactttcttaaggcactggttgaccccaaaaaacgaatgggtatggcccgttggatcagttatgccgctgttattattttggcaattgggagcgttggccttgctaaggcaccttcagccaaggcggtcggtgataattcacctctggcaaagcagttgaagcgacacagtgagtcggctaaagaaaaggctaaacgtctggaagcaatgcgctccagtctgtcagagcagaaaaaagcggataaaaataaggccaatgagtcgtcaagttcgcgcgcgcaacaatccagatacgcttcgcaggccaaaacaaagccggtgaatcaggactatgaacgttatgggctaacccaaattcaacttcagcaagctcaggatgttaccttcacggcagtcggtgactcagttatgcttgacggtgagccgggacttcaacagcttttcccaaaagcggtgattgatgccgcggtttcccgacaaatgatcaatagcattgacttggtgcgcagttatgctgaaaaaggcgtgttggcaaatatcgttgtgatcggtcttgggactaatggaccgttttcggacgatcaattagcccaaatgatgcaagccatcggacctgatcgtcaggttttctggattaatgttcgcgtaccgacccgcgcatggcaaaatgatgtcaatggcaaattagatgctgcccaaaagcagtacaaaaatctgacggttattgactggttccataaatccgatggtcatcctgactggttttacaatgatatggtgcatatgaatccaaccggcaatcccgagtatgcggcatttgttgccaaaactattttggaaaagattaatgaatagccgtttttatgacgttctttagtgaacggtcattgttcagttaaatcgagcctagaggtcatgccattctctaagctcgattttttataatattggcgactcggtttagaaaaaatagacggcgtgaaagtctatgacagcaatgattccgggataatcgcagagaacttgtggtagactacaaagtgaagtttgacagaataggaagtatggtatggaaattcaatttttggggacaggcgcaggttcaccttccaaagtccgcaatgttagcagtttggcgctcaagttgcttgacgagcgcaatgaggtttggttgtttgatgtgggcgaaggaactcagcatcaaatcttacagaccacgattaaaccaaggaaaattgccaaagtatttattacccatttgcatggtgatcatatttttggcttaccgggctttttagctagtcgggcaaatcaaggcggcactgaaccgttaacgatttatggacctccggggattgaggactttgttaagacgagtttgaaggtttctcagagtcatttgagttatgcaattaaatttgtattgttgcgacatccaggcgtgatttttgatgatcagacctttaaagtcagttttgatcggcttgatcatcggattaccagttttggatttcgagttgaagaaaaaccacacccgggcgagttattgattgataaggtccgcgccgccaagattccggctggaccggtttatgcttcgttgaaagcaggcaaaaccgtcacattaccggatggccggacttttgatggtcatgacttcatcggatccgcgcaacccggccgaacagtggccatttttggcgacacgcgtatgtgtcgtcgggccttaccattagcagccggggcagatgtcttggttcatgaaagcacgtttggtccggatgaaagtcaactggccaagcagtattatcacagtacgaatcttcaggcagccgagttggcgaaacgagctggcgttggtcggctgttgttaaatcatatttcggcacgctatcttggccctggtgtggcaatgttagaaaaaagtgcacggcatattttcccgcaaacgcatgttgtcagagatttggaggaaattaacattccatttgcaagcccgcaactgcaaccgacagtttctgctaaatgacgattccggtttgatgagacatcaggcaagcgttgttgaagattacgggaaaattgggcaatataccgagttgaaatgcgaaaactggcgcagaagtatagggacgcgtcacgactccttactttttgacgattatcggtaccagttcacactcacacgtgctcaggagggaactttatggtgaaaaaacatctgaccgttgtcatttctggcggatcggctggcttgggaaaggcgatcggactcgaggcggcgaaaaatggtgcgacggttgtatttttggcgcggcgccgagataaattacgtcaggctcaggctgaagcaacagcgctttccggacatccggcttatgcttttccagtggatgtgggtgatccggtggcaattgaagcggcggttgatcaaattcacgaaacggttggatcggttgatgttttggttaatgcagccggttttggtcactttgaaaatgcttttgacacggatatgcggttagtcgaacggatgtttcgggttaatgttttaggtgttatgtatctgaccaaactgttgggtcgtgatatggcaatacgcggtcagggacagattattaatgttgcctcaatggctggtaaaatggctaccccaaaatcagccatttattcagcaacaaaatctgcagtgatcggttatagcaacggattgcgacttgaacttaaaccatttggcgttcatgtcacgacggttaatcccggtccgattgcgacggattttttcaaggcagccggtgctttggattatctcgcaaccgtttcctggctggcattggatccggatcaacttgcgcgccgaatcgttgggacatttgaccatccggtgcgggaaatcaatgcaccgcgcgtgatgaatctgggtgccaaactatacacattatttccaggtatcggtgactggctagccggtggtatgcttaataaaaaataaaggggtggctcacatgaaaagtcagcaacgttttattatcggactggttcttgccttaatcttgattatttttgctttactgaacggccaaggggtgtccgttaacttcttcggcattcagttagaatggccgctgattgtgattatcgcagtatccgtactgatcggtgcggtggtaacctggttaatctccaccagtgccgttgcgagcgctaagaagcagatcaaagaacttcaacagcgcgtaacggaattgaccaagacaaacaaaaacgaaaaaccggcgccgaaaccggttcaggcaccaaaagaaacgccttctgatacatccaaaaactaaacgaaacgacgcggatattttgttcgcgttttttatttaaaatagtttgaccttaactgaccaatatcgtaaagtgaatttgaaaacaatgaacagttatggaggcatgatggatgaatccagataattttacgcaagcggtggctgaagccttgggtgctgcccaacaaattgcccaagtccgccaccatcaagaaatcgatattccccacgtcatgaaaagtctggtgcagcctaatcaattagctgagcagatttatcgtgaagctggtgtcaacattcacgggttaaatgccgcgattgacgctgcgattgacgcagagccggtgattgaaggcgcaagcggatacggccaaaacatgtcgcagaatctggcgcagatgttaagtgatgccgatacgatcaaagatgagtttggtgatacgtatgtttctaccgaggcgctgttactggcactctatgagcagcgttacaacacgattacccgctatttattggatgatgccaaagttgacgccaaaaagctgcgggcagtcattaccgagattcgcggcggcgagaaagttaccagtaaaaacgctgaggctaattataagagtcttgaaaaatacgggactgatctggttaaagaagcacgcagcggcaagatggatcccattatcggtcgcgatgaagaaatccgcgatgtgattcggattttaagtcgcaaaaccaagaataacccagttctgatcggagaaccgggtgttggtaaaacagcgattgtggagggcttggcgcagcgtatcgttaaaaatgacgtgccagacaatctaaagaataaaacgattatttccctcgacatgggcagtttggttgccggtgccaagtatcgcggtgaatttgaagagcgtctgaaggccgttttgaaagaagtcaaaaagagtgaaggtcaaatcattctgttcattgacgaaattcataacattgtcggtgctggcaaagctgagggatcaatggatgccggcaatttgcttaaaccgatgctggcacgtggcgagttacatttaatcggtgcgacgacgctggacgaatatcgcgaaaatattgaaaaagataaagcattagagcgccgattccaacgggtgctggtacaagagccaactgtggaagatacgatcagtattttacggggcttgaaggaacggtttgaaatttttcacaaagtgcgcattcatgattcggcgttggtggctgccgcgacattatccaatcgctacatcacggatcggtttttaccggataaggcgattgatttagtcgatgaagcctgtgccacgattaatgttgaaatgaactcgcgcccaactgaactggacgtggccgagcgtaagcagatgcagcttgaaatcgagcagcaggcgttaaagaatgaaagtgatcccgcaagtaaaaaacgcctggaaaatgcaaacgccgaattggcaaatttaaaagaaaaaaccaataaactcaaagcacagtgggaagctgaaaagaaggacattcgccagcttaacgagaagaagtcagcgatcgacaaagccaaacacgaactggaagatgcccagagccgttacgatttggaaacggctgctcgtctgcaacacggaacgattccacaacttgaaaaagaattgcaggcaatggagcacagtgatcggccgcagtcttggctggtccaagaaagtgtcacggctaatgagattgctgctgttatttcacgagaaaccggtattcccgtggcaaaactggttgaaggcgatcgtcaaaaattgctgcatcttgccgataatctgcatcagcgtgtcattggtcaggatgaagccgtcacggcagtttcagatgcggttttgcgttcacgcgccggactgcaagacccaagccggccattagggagtttccttttccttggtccgaccggggtggggaagaccgaactcgcaaaagcgctggccgaggatctatttgattctgaaaaacacatggttcgaattgatatgtccgaatatatggagaaggcgagtgtttcacggttggtcggtgcggctccgggttatgtcggttatgaacaaggcggtcaattaaccgaagcagttcgccgcaatccgtatacgattgtcctattagacgaaatcgaaaaggccaatccggatgtcttcaacattcttttgcaagtgttagacgatgggcggttaacggacgggcaaggacgcaccgttgactttaagaacacgatcatcattatgacctctaacctcggctctgaatatttgctggatggcgtgcaaaaagacggaactgtcagtcagcaagctaaggatcaggttcgtcagttgatcggtaaagcttttaaaccggaatttctcaatcgcattgacgatatcatcatgttccatccactttcactagatgatgttaagaagattgccgttaaggatctgcatgagctgggaacacgcttggcagaccagcaaattagtttggacatcacgccagaagctcagacctggttggcggataagggctatgacccggcatttggtgcgcgtccgttgcagcgtctaattaccagtgccgttgaaacgccgttagccaaagagctcattcgcggaacgattcagcccggtcaggaagtggtcataaccgttgcggatgatcagctgcaattcaaagcaaaacaagtagcagcgaagtcataagcctgtaatagctgaattattctgtaaagacccttgccttgacgccgcttttcatgtatgattagcgttgctgtgacagaacatgtttctgtccacgcgtgacgatgattggacttgcattttgatcatcgaccgtataaagtagtttagaaatcttactaaaaaaggggttttccgctcatggcagttccagcacgcagaacgtcaaagaccaagaagcgtatgcgccgcggtcacattaagttgaatgtgcctaacttgcaattcgatgcagcaaccggcgaataccgtgtttctcaccatgtttcacctaagggttattacaagggtgcacaagtggttaagaagtctgacgacaacgcaaatgcataacaaaaagccaacatctcgggtgttggcttttttgttggcgccaaaggatggcggcactagacgtcagcagtacgtggcgttcaacatttctttcatgacgaaactgagggttatctagttttcaaaaccacatctcatgatataatacgactaaaagaggtgcgatcaatggctgataacaaacaattttcggattacttagcccagcttcaaaaagcccaatttccgcggtgggctgacttaccgcaatttgatctttacatggatcaggttattcagtatgtcaatgatattgtgacgccacttggttttggcgaaattacatcgactatggtcaataattacgtcaaaaaaggcgtcatccaagcacccgtcaagaaaaagtatcgccccgaacaattagccaacatactggtcattgccatgttaaaaccggtttttgctttggatgccattgccaaggggattcagtttgctaaagaaggccgcccggtagctcaagcttacgatacattcattttgacttttatcagtgccattgagcaggcaaactccgacttcaacgacaccgttgccattaatcgaaccgttcagccaagcaccgctgccacgcaacatgccgtggtttcgttagccatcaatgcggttttgcaaaaactgatggttgagaagctgctgacgctcacccaagtccctgctaatgagaaaggaaaaaaggcatgaagctgaccattttatcgacgagtgatacccatggctttgttttgccaacgaattatgttaaacgcgaccagaatctgccgttttcattggccaaggccaaaacggttttggatgcccaaaaagcgatggcagaagggcctgtgctgaccatcgaaaacggtgactggttgcaaggctcgccattagcctattatgccgccaagatgagtcggaagcctgaacagttgacgcaaatctacaatgcggttgggtatgatgcgggaattatcggtaatcatgaatttaactatggttccgattatttacgtcaagcgttggcgacactcaactacccaacgttaaatgccaatatcacgaaagccggtcaaccagcgtttggcgcgccatataagatttttgaacggtcagggatcaaaatagctgttctcggcttaaccaccgcgtatattccgcattgggaggcacccaaacatattgccgacctccaatttgaggatgtcattgccactgcgaacgattacgtgccgcggttgcgcaaagaagcagatgtggtgatcgttgcttaccatggcgggtttgaacgcaatttaaaaaccggcgaaccaactgaacgcttgacaggagagaatgttggctacgcattgacgcaaataccgggaatcgatgcactgatcaccggtcatcagcatcgacagttggcggcgatcgtcaatggtgtgccggtgacgcaaccgggttatcgtggtgaggcagtcggaaagataacgctgacgcttgcgcagacaacgaccggttatcaagtgacggatcagcaagcagttttggttaaagccggcacggttaatcccagcgcagttattgagcaagtagcagaaccgttaaatcaagtcgttgaaacgtggctcgatcaaccattagcacgagttgaaggcgatatgcggattcacgatccatttgcggcgcgggttaaagaagtaccttatattgaattcattcagcgggtgcaaatggcaagtaccggtgcggatatttccgggaccgccttgttcaacaatgaagggcgtggctttggctcaataatcacgatgcgcgatgttgtcactaattatatttatcccaacactttggcggtgctgcggctgactggtgctgaactgaaggccgcgttagagcagtgtgctacttatttttccctaaatgctcagggtcaattgatggtcacgccgcgatttgaacggcctaaaccgcagcactacaattacgatatgtaccaaggcattgattatactttggatatttccaaaccggttaaacagcgcgtcacgaaactaacttatcatggcaagcccgtggtcagcacgcaaacttatgacgtggtgatgaaccaatatcgagctgcaggcgggggcaattttgccatgttcggcccggaaaaggttatccgcgaaaaccaaaaggacatgactgaactgattgctgattatttgaaagctcatccggttttaaaagccgaggccgaccataactttaccgtggtaccgtcaatgtgacactgagtcatattctgcttgtcaagtggcgggtgaacgcttatgctgatgagcgtcatcattaggttaagtgaaaggaatgttccgcatgaagttttggaaatatggcctgattggtttattagcactgctgctagtaggctgcggccaacaattaagtacgacaaaggcaacttacggacgcaatggtttggttgcgacgatcaaaggcagtgcgagcggggttgatcgggttcattatactagtcaagccggtaatggaagcgtgccggtgaagagcggaacgtttgtggtcaatgtaccggtaacggatacaacccaacagatcaaactaacagcgggatcgcttaaacgtgaagtcaacgttaaggcaggcacatcactagggcagtacactgctattgcgaccaaatttaatcaaatgttggccgtttcgagtctctccaaagcagatcaggcaaaactaaagcaaggacaggcagcagcggctgagcttcagaaaagtgcggcaacgatgacgcctgcagaaaaattgacggcggcacaacaggcacagacgctaaaaacattgatggcacaagcaactgccaatacccggggcaagcagttaccaaccaccgctaaaaccggcatccagtcgattttaaaaacggctggcgtcaattatcgtgccagtatcgtcaacggtaaggcgatgggctttgccgtcgttgtgcctttgtccgtgcttaaagacagtaagaagatggaacaattcgcgactggttttggcttgttgagtacagcagtcggagctaatgctaagactgtcttctcgcacttcaagaaactgacaaaagatgccaaatcgaagaacaactcgacaacgatcaagacaattaagagtaacaatgttaagtttgatgtgggttattcaaccaccgacttgtatctttatgtaaccaagtagccaagtttaagcggttgacgataccattaaaaaagcactcgagaaatgtctgccatctcttgagtgcttttttggcgccgcttcgcttgattcacatgttcggcgcaccttacttaatgttctggtttttccgctgacttagcaaaatgttgcataatcggtgggaagaaaaataaaatgacaacaaagatcacactgacaatggcacttgtctttggatcgtaactgctgccgctcaaggcgccaatcaggaagccaacaacttggccgaggatcacgccccagatgatggtaggtaaataccgcatgaaatccctcttttctgtcgtcatcttaccacgactatcgaggaattcaactgaaattaaattattttccagtataatggaaatgaggtggcaagatgacgtttacccaattacaggttcacagcaattataccttattacacagccctttggcactgcctgatttgattcaggccgcaaaaaatcggggttattcagccgtggcattaactgacaccaatgttgtttatggcctagtagagttttatcggcaggcaaaagcggcggggttaaagccgttattagggatgcaaatcgaaattgccgatgccaagttgcttgtgattgccgaaaataataccggttatcatcaattgttgaaactctcaacccaaattatgcttgcccaacagccgcttgcatttgctgatttgctgccgctgaatgggctggcagccgtaacattgcccgattcaccttttggcgtagcagtttctgagcgtcacgaagatcaggcacagacttttctgacaacgttaaaagctaagcaaccaagctccttgtacattggtgtggatgaggaacatcttgaaggaacattacctgcgtttgcggacaccgtaaagttaccgttacttgctttggggaatgttttgtaccgcgaccccaccgatgcctttacgcaaaaggtgatggtggcaattgaagcaggaagtcaattaaactttcgcgatccggttttaacggatgccgggccagcgtggttaaaaccgccaaccgatgcggccaagccgtttgtgcaagccggcttgcaagcggcggtgacacagactgaagcaattgctgcgcgtgccgatgtgacgattgattttaaacagccccagttaccgcactatcagacgcctgatcaaacgtcttcaaaagattatttgaccaagttggctgaatcgggtttggccaagcgctttcatgggcagtcgattccgccggcttatcaagatcggttggagtatgagctacgggtcattattgaaatgggctttgcggactattttttggttgtctgggacgtgatgaattatgcgcacaaggtcaacattatgacaggcgccggccgtggttctgcagcaggttccttagttagttatgcactagccattactgaagtcgacccgattgaatataatctgttattcgaacgatttctcaatcctgcccgagcgcaaatgccggatatcgacttggatattcctgacaatcggcgcggtgagttgattcagtatgttcacgacaaatatggcaagaatcatatggctcagatcattacattcgggacttttggggccaagcaggcaattcgcgatgtcgcccgggtttttggcttgagtcaatttgaaagcaatacctggagtaaagctattcctaacttatttcatattgatttgaaaaccgcgtacgaacaaagtcagccattgaaaaatctggttgccgattcgccaaaaaatcggatgctttttcaaacagctttggctttggaagggttgccgcggcattattcaacccatgcggctgggattgttttgtcagaagaaccattgactgataccgtcgcgctccagcctagtggcgatggactcgaacagactcaggttcccaaagacgatgtggaagcactcggattgttgaagatggactttttaggtttaaaaaacctcaacatcttggcagcagcaagtcatttcgtcacccgcgatacaggcaagccgtttgaccccaaggcaatcccgcttgatgatcaacccacgctggcgttatttgcgcgtggcgacacaaatggggtcttccaattcgagtcatccggcatcaaaaacgttttacgcaaactacgaccaactgcttttgaagatgttgtagcggttaatgccttgtatcgtcccgggccgatggagaacattgataccttcattgcgcgcaaaaacggtcaggagccaattgcctatccggacccagcgctggccaaaatcctaaagccgacttatggcgtcttggtttatcaggaacaagtcatgcaggttgccaacgtcatgggtggtttcagtcttggcgaagcggatttgcttcggcgggcgatgagtaagaagaaatcttccgttctagctgcggaacaggataaatttattgaaggtgcccttaagcaaggcttcccggaagcaaccgcgaaaaccgtttacgcctatattgatcgatttgctaattatggattcaatcggtcacacgcggtggcctatagtaaagtggcgttttggctggcttatctcaaagttcactatcctgccgcctttttcgcagcattgatgaacgccagcatgaacaacctgccaaagctacggacgtatgtacaggaagctaaagcgcgcaaagtggggttacttggtccggatatcaatcaaagcaatggcggctttaaattgagccaaggaaagatccgctttgggttactatcaattaaaggcatgcggcgggattttgtcgaagccatttttgccgcccgcaaaaatggaccgttcagggaccttcgtgatttattgcaacggcttgatcctaagtggttgaaaaccgactactacaaagcaccaacgcttgctggcgcttttgaccaattcagcaataaccgtgcgcaaacgctggctaatttggatgagctgattaattccgttaagttagccggtaatgatgtcgggttattttcaatgttagcgccaaagaccattgaggttcccgagatgccggcgagcgagcgcttagaggcagaagcagaagtgctcggggtttatctctccgggcatccggttgataagtatgccccgctaaagacccagtatcgccttattaatgttagcgatcttgaagaaggacgagccgttgacatcttgctattagtccggcatatcaagcggattcgaaccaaaaccggtaaacccatggcatttatcgatggtcaggatgcgaccggtaacgtgtcattaacaatctttcccaatttgtatccaacgatcgagaatctttcggaagacatggttgtattagtcagtggccgggtcgagaagcgcaatgatgatttgcaattggtggtcaatcggatacaggatgcccagccattgttagccaatttgccgaccgcggaattgttcattcgcatggatgccaaggatacggcgatgcgaaccgatttactgaaaaaactgcaagctgctcacgggacaacccccgtcattacggttgatactgccacccgcgaaagcattttgctggataaacgttactgggtcaaggcgcagacggaactgatcgatgcgttaaagacacagtttggcgcgaacaatgttgtgttaagaaaacggcaggaaacctagagaaaattgtaaaatgttctcattttcagggactttgtttcagaaaagtggtaaactcaatgagtatttgtggtaggacatatcgcaaaagaatatgcatgaggtgaaataatgaaacgcattggtattttgaccagtggcggtgatgctccaggcatgaacgccgcggttcgagccgttgctcgcaaggcgatgcatgaaggccttgaagtatatggcatcaattatggctttgccggtttagtggccggtgacatttttaaaatgagcgagtcaacggttggtgacaagatccaacgtggcggtaccatgctgtactccgcccgttatccgcagtttgctcaagaagaaggccaattgcgcggggttgaacagcttaacaagttcggtattgaagcactggttgttattggcggcgatggttcataccacggtgcattggcactaacccgtcacggtttcaatacaatcggcttacccggcacgattgataatgatattccgtacactgatttcacgatcggatttgatacggcggttaataccgtggttgaagcggtggatcggttgcgggatacggctgcatcccatgaacggacctttgtcattgaggttatgggacgtgaagcaggcgacatcgcattgtggtctggcgttgccggcggggccgaagatgtcattatccccgaacacgacttcgatgttaaaaagattgcttcgaagttacaaagttcccgtgaacgtggtcaaaagcatgcggttatcttgctggctgaaggcgtgatgcacgccgatcagtttgccaaggaacttgctgcctatggtgatttccagttacgtgctaccgttttaggtcatatcgttcgtggtggtgcgccatcagcacgtgaccgcgtattggcttcccaaatgggtgcttacgccgttgaactcttgctgcaaggcaagggtgcgttggcagtcggcattgaaaataacaaaattacggcgcatgatgtccggactttgtttgatgccaagcaccacgccgaactttcgctctacaccttggcggaagagttaacattttaatttttgtaaacaaacgacattaacgtctgtttaaataattgcaaggagcgatttcatttatgaaaaaaaccaagatcgtcagcacacttggacctgcaagtaacaccactgatatcatcgttaagttgattgaagcgggtgccaacgttttccgtttcaacttctcacatggtgatcacgaagagcatttggcacggatgaacatggttcacgaagctgaaaagatcacgggcaaaaccgttggtatcatgcttgatacaaagggtgccgaaattcggacgactgttgaggatacccctaatggcaagattgaattccatacgggcgataaggttcgtatctccatggatgcaagcctgaagggtactaaggaaaaggttgccgttacttatcctggtctttatgatgatacccatgttggtggccacgttttgttcgatgatggcttgatcgacatgaagatcaccgaaaaagatgagaagaaccgcgaacttgtcaccgttgttcaaaatgacggtgttcttggtggcaagaaaggggtcaacgcacctggtgttgcgatcaacttgccaggtatcacagagaaggattccaacgatattcgttttggtctggacaatggcattaactttattgctgcatccttcgttcgtaagcctcaagatgttttggacattcgtgaactccttgaagaaaagaacgcacttaatgtccaaatcttccctaagatcgaatctcaagaaggtatcgacaatatcgatgacatcttgaaagtgtctgacggcttgatggttgctcgtggcgacatgggtgttgaaattccgtttgaacatgttccgatcgttcaaaagcgcttgatcaagaagtgcaacgctttgggcaaaccggttattaccgctacccagatgttggattccatgcaggaaaacccacgtcctactcgtgccgaagttaatgacgttgctaacgctgtttttgatggcaccgatgcaaccatgctttccggtgaatctgctaatggtgaatatccagttgaatctgttgctgcaatggcacggattgatgaatacaccgaagcagctatgcaggatcaggatgcttttgcattgaaggaatacagtaacaagaacattaccgaagcagtaggtcagagtgttgcacacacggctcgtaaccttggtgttaagaccattgttgctgctactgaatctggctacaccgcacggatgatctccaagtatcgtcctaaggctgatattcttgcgattaccttcagtgaaaagactcagcgtggtttgatggtcaactggggtgtttatcctattgttgccgacaagcctgccaacactgatgcaatgtttgacttggctaccaagaaggctcaagatcttggctttgctaaggaaggcgacttgattctgattacagccggtgttccagttggcgaatcaggtacgactaatgtcatgaaggttcaactgatcggttccaagctggttcaaggctctggtgtcggtgatgaatctacaatcggtaaagctgtcattgcaagcaacgctcaggaagccgctgccaagatgcaaaaaggcgacattctggttgttaagacaactgacaaagattacctgccagcaatcgaaaaggccgctgccttggttgttgaaacaggcggcttgaccagtcacgctgctgttgtcggcatcgcgatgggtattccggttgtcgttggtgctgaaaatgctaccagcgttatctctgatggtcagattatcaccgttgattcacgtcgcgggattgtctacaagggtgctactaacgcactttaatcatcatcagtttaacaacgatttttctgaaactcctgaggaaactcgggagttttttattatatcggctagataacccgctaacctgagtgccagtgggtaaaatcgcttaacaggctcgtcagtgtgattgggatagcatataataagacccagcgtgcttgatcggataaaaatataatttcagccgatgaaggaaatcggcaaatgattggaggaagatagccatggaaagttggctgtttttactagcgattcttgctattgcactcattggtaaaaataaaagcctcgtcatcggtgtggccgttgtcatggtgttaaaattaattccgcaaacgcaacatttactcaagttattgcaaagtcaggggatcaattggggcgtgacggttatatcggccgcaatcatggtacccatcgcaaccggtgaaattggctttaaggaactactgcatgtcattaaaagtcctgcagggtggattgcaattggctgtggggtattagtggcggtattgtctgccaaaggtgtcggcttgttggcggtaagtccggagatgacggttgctttggtttttggtacgattctgggagttgttttcttaaaagggattgccgccggtccggtgattgcaagtggtatgacctatgtaattttaaccgtttttaatctcttaccgggtcgttaagacggtgttgttaacatgtgaaggagcaaaaaaatgaaatttaatggtcaagtcgtcaccgcacaagtgacggatcacaatggaaaagaagtgtttgcccaatatgagggtgtaactttagcaatcgaccggcttgaattgccgacattaccagaaatcggtagtcaacttaagggccttgcgtatgaaaataaacatggccaggcgcgattgacgaccaagttgcctaaggtggggcgcgatcactacgcttttgctccggttgttgaagttcgccgagatttaggcgtctttgtcgatatcgggttaccggataaggatatcgtggtcagtgaagatcagctgccggaattaagtcgtttatggcctcagcgcggcgatcgtctcatgatcgcgctgacaattgataagaaggatcggttgtgggggaacctagctgatgaaacgattattcgtgccgttgccaatcgtgcgaaaccggatcaaatgaatgctgatgtcacggcaactgcctatcgtttgaaaatggcaggaacccgggtattgacagatgacttttatcttggttttattcatccaagtgagcgcgatgttgaaccacggctaggacaggtcctgcatgcccgcgtcattggcgtgagtgaccaaggcgaattgaacctgtcattaaagccgcgtgcttatcaagcgattggtgacgatgctgctatgattttagccgttttgcaacatgatccggcaggcaagattgcctataccgataaaagtgatccagctgtcatcaagcaggtttttggcatcagcaaaggcgcatttaagcgagcattaggtcatttactgaaggccggcttgatcaaagaagaagccggttacacggttttattagattcgaatagtcaaccatctcaggaggcatagtatgcatgggttgattgctgattttattcattatctggatgttgagcgcgggctggcccgaacaacgcaggtcagctatcagcaggatttaaccacctttatggcgtggttaagcgaccaaaagcaaacaacttttcccgaagattttggggttattcaggcgttcttaaagcatcaaaatgataccaaagcgcctgcatcagtcagtcgaatgatttcggcgttacgcaagttttaccggttcttgttacgcgaaggtgccattaaatctgacccgatgaccaaaattgatactccgaaaaaagcacaacatttaccggccacgttatcagggacagaaattgatgctttgatggcaaagccggataccactaagccgttgggattgcgtgatcgcgctatttttgagctgatgtatgcgactggcttgcgggtatcggaagttgtgggattgcgattggatcagttacatttagcaatgaacttgcttcaggttaccggaaagggcgataaggagcgactggttccaatcagtccccaagcagccgattgggttaaccgttatttgcaggaatcccgtccgcgtttgatcaaacaccagcaacccaaggcagtgttcgtcaactttcatggtcatgcgctcacccgtcaagcaatttggaagaatctgaaagcctatattgcaagtgttggcattgaaaaggacgtaacaccgcatacgttacggcacagttttgccacgcgcctgttggaaaatggcgccgatttacgggtggttcaggagttactggggcatagtgatattagtaccacccaaatctatacacatctgagtaatcagcatctagtggcggtttatcataaaacccatcctcgtggctaaccgtaaccgacaaccgttgagacgttacgggccagatcttttgttgctttgcggaaggtgactaaagtttaaatctaagcacaacggcaggtagccaaccgctattcccatggcatagtccaatttagttcacattgccccggtctcgtttctatgatagagtgtctggagagtatcttttggaggcaaatatgctggttaaatataaaaacgactatgagaaaatcgcgatgggacttttatcctttatcccggatctcaaagatgtcgggcatctgaagactgaacttaagatgtacactgaagatgattcccatgcgttgtatttgtataaacatcatcatgattttgtcggtgtggtcggtgttgaattaagtgccgattttgttttggtgcggcacttgagcttctcgccaaacttccgtgatgaggccaccgcatttgccgcattggcagaattaacaaagctttttccagataagaaactgatgggtgcattggaacacgcatcgttgatagctgcttttaacaagtttcgaaaagaggatgaccatggcactgacactcgtgctgaatgatttctccgggccgttggatttgctttggcatttgattcggactaacgaagtcgatatttatgatattccaatcgccgagatcaccacccagtaccttgactacctgcaccaaatgcaggatttagcactggacgtggccggcgattattttgtcatggccgctaatttgatggtcttaaaaagccggctattgttgccacaaccggaaccggaaacaaccgcgccagatgagccgactgatccgcgagctgacttagtggcgcagttgttgacttatcaggtgtatcaggaagcggcaaaggatttaaagcaacgtgaagccaagcgtgcccaggcttttgccaagccaacaactttgccggatgaaaagatggcggtcccgcttgctccaggaacggtcaaactaattgatcttcaagcggcgatggcgcgggtcatgaaggcccaacaggcagcgcggcaaacgattgcccacatcgaaacggaaccggtctcggtagaaaaacgcatcggtgaagttttgcgtgccttgcaacaagatggtcagtgtttatttgcggatttattagcagtcaactcggtggaacaggtcgtgacgacttttttggctttgttggaactaatgaagaatgatcaggtgatttgcgaacaagatgcgccatttgatccgattacggtgacattgaaggaggctgcttgatggagccggtattagaggcaatcttatatacggctggcgaaagcggtgtgacgcttggcgaacttgccagtatcttggaaatcagtgaaagtgccatgcgccaacaactggaggcgtatcagcaacgattggccgcagacgaccagcgcggattacaagtacaacagtttgccgatcgatattacctgctgaccaaaccggcctttgtatccgcgattaaaaaatattttgcggggccacccgctgctggtctatcccaggcagcattggaagtgttggccattattgcgtatcagcaaccgattacccggatagaaatcgatgaaattcgcggcgttcagagctccggtgcgcttacaaccttagcatcgcgacaactgattaaagaagcagggcgcaaagaagcaccggggcgtccgattctatatgccaccacccagtttttcctggattattttggcctcaatcaattggccgacttgccgccactagccgatgcacctgaagatacaggagaagtcgatctctttacggcatttcgcgatgatgatcagtcacaaatggctgaagatgataagaaaatggagcaaaaccaacaacatgacaaccaaaaatgaacgactgcaaaaagtcattgccaacgccggtattgcatcacggcgacatgcagaaacactcatcgcatctggccacgttaaagttaacggtcacgttacgacagaaatgggcatcaagatcggaccgcatgataccgttgaagtagatggggtgccaatcgggaaggaagccaagcgctatttcctgttctataaaccacgtggcgttattagtgctgtcgaagataataaagggcgcaaagttgtgactgattatttcgaggacgttcaggaacgtctttatccagtaggccgactggattacgatacgagcggtttgctagtcatgaccaatgatggcgaattggccaaccatctcatgcatccgcgctatgccctggaaaagaaatatgttgccaaggttgaaggaatccctaaccgaccggcgctagcaccacttaagaccggtgtttcaattgatggtaaaatgacggcaccggcaaaggtcgaaattttatcaactgataaggctaagaaaaccgcaattgtggccttaaccattcaccaaggtatgaatcatcaggtaaaaaagatgtttaaagcagttggttttccagtgatcaaactttctcgtgaagcttatggtaatctgaccttggccggattgcagccaggggaacaccggccaatcaaacctcaggagcttcatgatcttcgtcaattaaccggtgagcaagaagaagcacattaattgttaacgcattcaaggtaaatgcttgaatttgtgagggttgtttgctacagtgtgattgtaattaaataatttggttcgtcttcagggcagggtgtaattcccgaccggcggtataaagtccgcgacccgctttttgcggtggaaccggtgtgattccggtaccgatagtgatagtctagatggaagaagatggggcttttttgaatctgtattcaatcaaagacctattcccccctgaaggaggaataggtctttttaagttccggaagacggcctcacggaggtaatgttttatggcaagtcgttctaaggttcatcgtttggtgggcattgcacttttggcggcaatcgggtatgtgctgatgatgttttcattcccgattattccggcatttccctttttaaagttggatttgtctgacttggttgttcttttagggggattactttacggtcctgttggcgggattgctgttgcgtttgttcggagcttggttcacttcgctttaactggcggtggtgttgttaacctgattggtgatttggccgcctttattgccagtgtcggcttcttgttaccagtcgtttatacgattcgcggtaagcatcggatttggcggcagattgaagggctggttttagggaccttgagtttgacagttgtgatgagcgtgctgaactggctggtgatcaccccgatgtatatggctgtcttcaatttcaatttagggatgtctttgactaaatatgttctaattggggttgtgccatttaacttaatcaaaggcgtcgtcatttcagttgccttctttgcaattgcaaaggcactggctccatggttagcacgtcaggaaatgcaaatgagccattaaaagctgttccggttttcatttgactgatcggttcacttagacaagcaaaaagcatccaacttgcgcggatgctttttgtttgcctgaaaatgttagcgacataaacgttaacaggaatcaatgcgtaatttatcgatagcggtctaatttggctggccggttacgcttgattattccgcttttgttggcgtaaacggagccgtgttaaacgggtggtcactgcgtttgatggcatgtgtcgggcaacgctgatacgcaagccgaaaatcaatttttgcatgatcatccagtggctttgtgccagtgttgcgatcaggcttataataagcaataccggcttcgtcatagtcaaacaaggctggtgccaacatttgacacagtccacaagcaatgcattcgggacgttccactctgccatataatgccatgttaatagaggactcctttataattttcagtttaaccacacccaagtatacaataatcaatgaaaaagaggtgactggcttgttgacagacttggccattcaattttttgatacccagccacggcgagagcgagctgtattcggcctgttagccggtaagaaaaccatttcaaatctctatgccgctttaacccaccagcaattgcaatggttgcagctttatccaagcctgtctaaagagttgtttttacaggcagtggcgcagttaaaaatgcatggtcagttaacaacgacagaaaccgggttggtgttaaccgcaaaaggccaacagtttcagcgtcaagcggcaaaacgggtgccattaccgacctactatcagccgtggatgcacctggcaaaatttgcgccgcggttctttttggccattcaggttttgtcagaagccagttaccactcacaggcatatcgtccgattagtaccgattgggcgaatcagcaagcggttaaacgctggtatcgccaactgaatatcgagtctgcgattgcggatttgattgcgctttttgaacggttgccgccgcagttagctgacatactagcggctaatctaattggtcacgattatgctggtcaagcgcaaccacctactttaagcgcacatttcagccgcatcaatgctttggcagccttagttaacgagattgcggcaattaaggatgaaggcaatccgtggtacgagctatggggcggcccgcaagatctggtgacgcgtccggcacgttatagtttacagcaagtccaagccggtgttggcttaaaggcgattgcaagtaaaagtcaccgtaaactgagtaccgtgaaagagcatttgctgctggcggctatcatgggagagtcgcttccggtcgaagaattgattccgcaaccgatccatcaagcattggatcagatcgatcagtggcaagatcatcaagtcttattggatacggttccagccactgatttctttcaggtacgcttgtttcaaatcttgaaattgcaagggagatggtcgcgtgtcgcaacttgaaacggccttggcgcagcattttggctttaaacagtttcgtcctggacaaaaagccattatcgaatctgttcttagtgggcgtgacaccttaggcattttacccaccggcagcggcaaatcactttgctatcaattgccgaccttaattaaccataaaccgactttaattgtcgaaccactgattgcattgatgcatgatcaagtgggaaggctgcaggcagcgggcgaaaaacgcgttttggcattatccgggcaaattgcgccgccccactttgctcagattttagcgtatttgaacgtttatcgctatctgtttatttcccctgaaatgctacagcgaaccgatgttatgtctgcgttgaagcagctagatcttgggctgctggtaattgatgaggcacattgtatttcacagtggggaccggattttcgtcctgcctatttacaactggggcgagttagggcgcagttacatgtggatgccgttttagcgttaacggcaactgcaccgaatcaagtccgcagcgatattttaaaccaactggcaatgcaaaatccgaatacaattgcggattcagttgatcggcctaatatttttctgggcgttgagatgtgtcaaaatgaacaggagaagcatcagcgcctagttcaactcttgcaagccaatgtcggaccaacgattatttattgtgccactagggcagcagcggaaaacttggcaacggtgttaaagaacgcgggattgaaagccgctttttaccatgccgggttggattcacatcaacgtgatttgattcaacgtcaatttcaatttgatcaactgcaagtcatctgtgctacgagcgcatttggtatggggatagataaggctaatgtgcgcttagtggttcatttatatgtacccgagtcgcttgaagcctattatcaggcaatcggtcgggcagggcgagacggagccgcgagtctggctgcaatgattgtgacgcaagatgacttgaatcgaagccggggactggcggggatgttgccggatcagacgatgatccagacagtttttgcccatcctgatatttatcgcgatttcgacgatcctcagataaatctgatcgaagcctatattgcagctggtttttcgctggcacaaacgcaacaacaattgcagcatcggctagcagaaaagcaaacaagttttatggccatggccgcatttgtcaatgaatcaggttgtcgccgtgcactgttactcaagcactttgattcaccgtccatttcacatcatgccttttgttgcgggccggtgacggcggaagtgctagagaagttagagacagcgaatgtatcggcacagcttccgcctaagcactggcaggcagtttttaggcaaatctttagataagcggcgtcttgatccggttcaatatgatacaataaatccatgtagtgaggaggatcgtgatggcggaaaaagataaaaaccaacatgataacgcggatcaagaacaacatcagggtgaggatgccaataagccttgggaaacccttttcgatgacgaccgtgacgatcagggcaatttaagccgagtcgccacccgtaagaagcggcaaggtagttcgaagctgacttggatattggctattttgctgatattggcagttttagcaccgattatttattataaagtcatggataatcaaggaagcagcggtggcaacctgtcaaatgacaaggttgtgattcaaagcgccaaaaagaccagtcattcatccaagaccaagaaatccgccaagtcttccaaaacgtctaagacttctaagacttctgcaaaggaagcctcaagtagccaacaggcaacatctgcgcaagcgagctcaaaggttagtcaagcacccagcgcctcccaaaaccaggagcaggcaagcgcgtcagcagcaccaagtcaggccagtacggctggcaactcctatacggtcaagtcaggcgacaatctttatcggattgcggttaaccacaacatgacgttggacgagttgttacagttaaacggtcttagtgccaactccggaatcacaccgggaaccgttttaaaagtgaaataatagtgacacggccctgttcggatagttaaatcgatgaacagggttgtgtgttgtggaggaagttcatgcagattgcgattgacggccctgcaagtgccggcaaaagtacgatcgcgaaacttgtggcaaaaaaattaggttatatttattgcgataccggtgcgatgtatcggactgttacttatatggcgcttaaagatcagttgccattggatgatgaaacgaccattttacagcatttgagtcagctgcagatccggtttgcgcctggcgatccagaacaacgtgtttttatgaatgatgaagatgtgacgttggcaattcgtgaaccggacgtgacaaataatgtttctcaagttgctgctttgccaggtgtccgaactgaattggttgagcggcagcgggatattgctgcaaaacatgatattgtgatggatggccgcgatattggaacaaccgtcttaccgcatgcggcgttgaaaatctttatggtggcttcggtgtcggaacgcgcaaaccgtcgctacaaggaaaacgttcaaaagggaattaaaacgccacttgccacgctggaagcggaaattgctgagcgtgaccgcaaagattcccagcggaaggtttcaccgttacgtcaagctgccgatgccattcgtatcgacacaacgcgtatgacaattgaagaagttgtcgcgaagatattagcattggttgcagaaaagaagcaggcagattgaccagagcaaaataagcgctggtaatttgattcgttttcaagtacaatagatccagtatacagctgcataggaggattttttggcatgagtgataataacgttaatgagaacaccgaaacaatggcggacgcccttaagagtgtcaccacagtaaagattggtgacactgttaaagcagatgtccttgctgttgaagataaacaattgatcgttgggatcgaaggaacaggcgttgaaggcgtggtcccgatcaaggagttatcaactcagccaatcgatgacattcacgatgttgccaaagttggcgacaaacttgatttagttgtgctttcaacggttggcaaagataaagaaaatggtcagttcctactgtccaagcgccgtctggaagcacagaaggtttggaaagaaatccaagctaaatacgaagccggcgaaaccattaccgcaccggttaccagtgtggttaaaggtggtttggttgttaacgcaggtgtccgtggattcgttccggcatccatggttgaagaccacttcgttgaagacctcaatcaatacaagggcaaagagcttgaatttaagattattgaaattgaacctagtgaaaaccgtttgattctttcacatcgggcaattgttgaagcaagcaaagccgaagcacgcaaagaaatctttgcaaaaattcagcctggtgatgttgttgaaggcaaggttgctcgtttgaccaactttggtgcctttgttgatcttggcggtgttgatggtttggttcatgtttctgaaatttcatttgaccatgttgataagccaagtgatgttttgaaagtgggacaagagattaaggttaaggttttgaatgttgaccctgaccgtaaccgtatttccctttcgatcaaggcaaccttgccacaaccatgggatgacatcgaagaaaaagcgcctgctggctcggttttaaccggtaccgttaagcgtttgacaacttttggtgcttttgtcgaagtattccctggggttgaaggacttgttcatatttcccagatttcccatgaacatgttgcgaccccggcggatgttttgaaagaaggccaagaagttaaggtcaaggtgctttcggttgatccggatgctcatcgtctggcattgtccatcaaagccttgcaggatcgtccagctggttccagcgatgcgtctgagggtcacgaaggcggcaataacggcaatcaggaacgtcggcgttcatcccgtcctcgtcgtggtaacgatcgccatcagtcaagctcgatccctgctgaatatcagcaagatgattctggcttctcactcggcgatatccttggtgatgcgttgaaagatgccgctaaaggtaacgatgatcaggatgataacaagtgattttaccatccgttaaaaagttgagccttggctcaactttttttatgctaacgctgctgtttataatttatatactggcagtgagtgaactagatcatgttaagctaccaataacaaacttggttaaagaaaggaggccgtgatatatggtcttaccaacacttgctattgtcggacgtcccaatgtcggtaaatcgacaatttttaatcgaattcttggtgaacgggtctcaattgttgaagatactcccggcgtcacgcgtgaccgaatttatggcaaaagcgaatggctaggaaaggaatttgcggtgattgatactggtggtattgatctcggtgatgaaccttttttagcgcaaatcaaagatcaagcagaaattgcgattgacgaagccgatgtcattttatttttgaccagtattgaagcaggcgtgactgacgcagatgaacgagttgcccagattctttatcgggccaataagccggtcgttttagccgtgaacaaggttgataaccctgaacgccgccaagacatttatgatttttattccttgggttttggcgagccgctaccgctttcaggtacgcatggtattggcttaggtgatgttttggatgcagtcctagcggcgtttcctaacgaagccagtgcggacgaggatgattcaatcaaattcagtttgattggccggcccaacgtcggaaagtcctcgttggtaaatgcgattctgggagaaaatcgggttattgtcagcccgatcgagggaacgacacgagatgccattgatactaaattcgaagctgacggtgaaacttttacgatgattgatactgccggcattcgtaagcgtggcaaggtgtacgaaaataccgaaaaatacgcggtgatgcgcgcgttacgggccattgatcgttcggatgtggtgttattcgtgatcaatgcagaagaaggcattcgggaacaggataaaaaagtggccggttatgcccatgaagccgggcgcggcattattattgtcgtcaataaatgggacacacttgaaaaagataatcgcaccatgaaagactttgagaacttaattcgtcaggagttccaatatctagactacgccccgattatttttgtttctgcgaagacacatcagcgtttacagagtcttccggccatgattgtcgaggtttcagaaaatcaaacccggcgaattcaaagcagtgttttaaatgatgtcttaatggatgccattactgttaccccaacaccgacagtcaatgggaagcgtttgcgtatttattatatgacgcaagtggccgtcaaaccgcctacattcgtggtttttgtgaatgatcccgatttattgcatttttcttatgagcgtttcctcataaaccagttacggcaggcatttgacttttccggcacgccgattcatgttattgcgcgtaaacgtaaataaatttgacaatttctgacaatgacttttcatttaataaatcgtgattttcgataaaggtttcaaggatctcagccaaaaagtttggcaaaaaccttgtcacaacgggcttgctatgctatgtttaaacctgaaatgatgatacataattatcattgtttcttcattcctgagcggtcaggaatgagcatgtttagatgttcacgcatctaatcaattatggaggtgaaatattcatggcaaacaaagcagaattgatcgaaagtgttgcaagtgcaaccggtttgaccaagaaggatgcaaccgctgctgttgatgcagttttcggttctatccaagattccctttcaaagggtgacaaggttcaattaatcggctttggtaacttcgaggttcgtgagcgcgctgctcgtaagggtcgcaacccacaaactggtgcagagatcaagatcccagcatccaaggtaccagcattcaagcctggtaaagcacttaaggatgccgttaaataaacggttttctgaggcaacaatgaagtaacaccaaaaaccgagtcttaacggactcggtttttgcgcgttttggcgaaagccgtttccggtgatggtcatcaggagcattcaaaatcgtcagacgcgtgttagacttacactagatagcgttcatatttaattattaagtcacggaggcagctatgagttacgcaaaaaagatgctggatgcactcgaggcgggacaaatggaaacagcgcgccaactgtttacgcaggttctggcgcatgacgatgacgaaacccaatacaatctggccgaagaactttacgcactgggattcaacggtcaggctaagcgtttgtaccagggcttgctgggccgttacccggagcaaggggatttagcgaccgccttggctgatatcgcggtttctgacggtgatgccgatgcggctttaaattatctcagtcggattcagccggatgatcccgcttatgttcaaagcctcatcagtgcggctgatgtttatcagtcgttgggattgtatgaggttagcgaacagaagttactaacagcgaagcgactggcccccaaagagccggttgtgacgtttgcactaggcgaattttattttgactggggacattttggtcaggcaatcgcggcttacaacgaattgcttgctgggggtacaaaagaactggccggtgtgaatgtcgaagcgcggcttgccgccagcttggctcaaaccggtcaatatgaagatgccgttgctgcgtatgaagacgttggcgttgacgcattggatctgaatggccggtttgaactaggtggtttgtacctgcagctgcacgatccggctaaggctattgcgaatttgcaggcagtgattgataccgatccgagttatgccaatgcctatttacccttagcaactgcctatgaggcacagaaccagcctgagaaggccctggatacggttcaggccggggttatggttgatgatacgaatccggacttgtacgcgttaggcggcaaactagcgcttagtgaggacaatcctgatttagcggaaacatatttacaaaaagcattgaagatcgatcctgaagatcaaggcaatatgttggcatggagtaattttctggtgcaagaagaacgtgatcaggagaacattgattttcttagtcgcattgatcaatccggcgatgttgatccgcaaatctactggaatatggccaaaagctacgatcggctggataacgtcaaaaaagcccgggaaaattacctgttagcgtttaaccgtttccaggattcgccggactttctacatgatttaattgatttcttccagtcaaccggagcccgtgccgagctaaaggcagcgctggttcgttatcttaaactggtaccgactgatgatgagatgcaaatgcggttggacgatcttaatgatgagacgtgatccggtttcggtcttaggttaatggccgaataaaaggcgtcggcgtttcttttgataagtgaacccttcacccagtgcttcatggacatccagaatgctaataaaagcacgcggatcaatggcttcaatcagccgttttgtgtgggcaatttcgctggaagccaccacggcgtaaacgacttgcttgcggtcatgggcaaagccgccttctgcatgcaaaaaggtcgttccgcgttcaagctcgtccataatcgccgtggcaattgcctggctgtggtccgatacgactaagacacccttggcagcataggcaccatcaagcgtaaagttgacgatgcgcgagaaaacgtaggcgccaagcagcgtgtacatcatgagctcaatgtttaagtatgtcagggaaacggtcaagacaatggcatcgaatatgagcagcgttcgccccattggcacgccggtttgctgctcaaggatgcgggcaacgacatcggtacctccagtggttccgccatgtcgataaataatcccactaccaaagccgccaaaaagcccggctaaaaccccggatataaacaagtcatggtgaatatcaatgcttaagggcacccgttgccaaatccacaaccaagcagataacatcaaagttccatagatggtgtaggctaaagcacgcttgcccaaaaatttgtagcccacaatcagcaagggaatattcaacaaaaccgtgctataagccggatccagaccccaccagtaacgaatcagcagagtgatcccggtgacgccaccttctgctaggtgattggcaatattgatatacacgagtccaaagccgtaaagcgcacagcccaaagtgatcactaaaagatccagtccgattcgcgtgttacgtgacatgagatgcctccctgaaaagattttaagctcattttaacagagattttatttttcggtatgattaaggggaggtgccggacgaaagtaagaggagaatttgatgcaattagatttaaaccagccagattttaaagcagcgatcccgatcttgaaaaaaatcgaagcagccggatatgaagcctattttgtgggtggcagtgtgcgagatgctttattgggactgccgattcatgacgttgatattgccagttccgcgtatcctgaagaaatcaagcggatttttaagcgtaccgtggatactggcattgaacatggcacggtgatggttctggatcatggcactggctatgaggtgacaacgtttcggaccgaatcggcttaccaagattttcgccggccggatcatgtgacatttgtacgctcgttagctgaagatttgaagcgccgcgactttaccattaatgccttagcagtgcgccatgatgggacgattattgacttatttgacgggttaacggatttaaaaaatcgccaattgcgcgctgttggcgacccgcatgaacggtttcatgaggatgccttgcgaatgatgcgtgccgtccggtttgaaagtcaactcgggtttcatattgaagcgacgactaaagccgcgattgccgctaatgcaccattattgaagcatatttcagtcgaacggattgctgcagaattcaaccggcttttggttggcattgaccggcgtgccgggatgcaagactttcttgatacgcacctgtttgcctatgcacccaagctagcgcctcatcaagcagcattgcagcaatttagtgaattgccaaatcaagcgttcacaagtattgccagtggctggacggcgttgatcttcatgcttaaagtcgcgccggaatcgtttttgcctgcgtggaagcaatccaatgacttgatgggtttagttgaccaagccgtgaccttgttgcggaaaatgccgactccgactgcttgggatctctacagcgccggatcagcagccgtggccgtggtcagtgaagtcgccgcattgatggatcaccagtttgtcccggcatcgctgacgactgcttatgaagcgttgccgatccattccaaaaaaaccttagcactgactgggcgtgatttaattcaagctggcgtacgcccggggccggcgatgggcaagattttgcatcaaattgagtaccgcgtggttgatggcagcttgccgaatgattcaaaaaagttgttagctgcagctattgaaatgtctcgagaaccgtcgtaagtgtgttatgataggcatgtaagcacattcaacaacatcatgaagggcgaccatattagccgtaatgcgcgtgaaagtatccggttgattgttgctctgacttgatggcgaagggggatttccaatggcagaacatgtttttgaacagttagtttttcattttcgtaatggtgacgaatggacggtgcaacatgatgaattggcagatgtctggatcagtcgggtgacgaccagttacggccggattcacggtggccagattcaagaaattcatccatgcaagagctttaaggtcgagatcttgcctgaagccgaccacgttaagtccagtgatattaacaccggctcactggaaatggggatgtttgggcgcgcaacaaagtatcaggacattgaaaagatggatctggtttttgatgatcagaccaaaaagcaggttcagatttattttccgttcaagcaaaaagatccaagcgggctcgataatgaatatcaaacgagcaagcttgccaaaaatggccacctttacattgtgattgatgctcagcataccgtggatgatgaatatccgcgaatttaaagcggcctgctaaactttaattatttcatcaatatcaggggcgtctgattccagtacgagcgattgaccgcttacgactgatcacgcgccccttttcttgtgccttgcttcttgctaagatggacaacgacaggaaatgagggacgacatgcagacgctaacagcacagggcctgagcaaggcttatggtgataagcaattattcaatcaaatcgactttttgattaacgaaggcgagcgaatcggtttgattggggtgaatggtaccgggaaaacgacgctcatccggtctttagccgggatggaatcggttgatgccggtacgattaagaccccaaagcagtatcgcatcagctatctcgcacagattccggagcttgatcccgacttaccgattatggatgcaatctatcatggtgattcaccggtttttcaagcaattcgccaatatgaacgcgctttggctgcctatacaaaggatccgttaaatcaagcaaaaaccgatgcctacaccaaggccgatgccaaaatgacgcaagaagatgcgtggtcggcggaaaccgatattaaaacgatcctcacgcaattgcacatcggcgacttaacggcacgggtcggcagtttatctggcggccaacaaaagcgggtcggtcttgcccaggtattaatcgagtcgccggatttgttattgttagacgagcccacgaaccaccttgattttgactctattgcctggctggaaaattatttgagtcattatcgcggcgccttggtcgttgtgactcacgaccgttattttctggatcgcgtaaccaatcgtattttcgaattagaccgcggtcggcttttccagtatcaaggcaattaccaagcgtatgtcgccaaaaaagcagaacaactggaagccgaaaagtcggctgggcataagcaggcacaactttatcgccaggaactggcatggatgcatgctggtgcccaggcacgatcaacgaaacaacaggcccgtattaatcggttcaaggcgctacaaaaagcaaaagacgaagcaccggcacctgaccagcagctggatccgattcaaatcgcaagtaccagactaggcaagaaggttattgaaatgcatgatgcgagcttgcgatttgatcagcaggtcatcttaaatcattttgattggctggtgcagccgaatacccgcatcggcattaccggtcaaaatggtgctggtaagtcaaccttgctcaatattattgcaggtaaacaagcgcttgatagcggcaccattgaattgggggagacagttcggttaggttactatacgcagcttaatacgaatctggatccaaaaaagcggatcatcacctacttgcaagaagtgggcgaagaagtcgtgcaggcagatgggcagcgcgtttcggtgactcagatgctggagcaatttctatttcctcgcagtatgcacggcactttgattggccgcttatcaggaggcgaaaaacggcgcctatatttactacaggtattaatgcgccaacccaacgttttactgttggatgagccgaccaacgacttggacatcgccaccttgaccgttttggaagattatcttgatcatttttccggcaccgtgatcaccgtgtcacacgatcgttactttcttgataaagttgcggatcagctgcttatttttgatggtaatggccgaattgaacgcgccgtgggtgaattttccgattatctggcaaaacaaaaaccgcagtccgctgcatcaaaaacagactcagcctcggccaagccaaaagcaccggcaaaaaaagcggcgccaaaacagaagtcaaagctgacatatgctgagcagatagagtatgataagctccaacaagaacttgatgaattagacgagcagttggccaaggttaaagcagaaatggcgcaggtcaatggtgaggattacgtgaagctgggcgatctgcaggcacagcttgatgcgattaatcaggatattgaccagaagttcgatcgattcgccgagttggatcaatatgtgtcaagtagtgaacggtaaaggagcagagcagacaatgttagaacagccatatcttgatcttgcaaaaaaagttcttgatgaaggccacttcaagcctgatcggacccatacaggaacttacagtattttcggtcaccaaatgcgtttcgaccttagcaagggctttccattactgacgaccaaaaaagtaccattcggccttattaagagtgagttgttgtggtttttacacggtgataccaacattcggttcttactccaacacaagaatcacatttgggatgagtgggcgtttgaaaaatgggtgaagagtgatgaatatcgcggcccggacatgactgactttggacatcgcagccaaaaggatccggaattcgcggcagtttatcatgaagaaatggctaaattcgatgaccgggtgcttcatgatgatgcttttgcagccaaatatggtgatcttggcttggtttatggatcccaatggagggcttggcatacgagcaagggtgacacgatcgaccagttgggggacgttattgagcaaatcaaaacgcatccctattcacgacggctcatcgtgtcggcatggaatccggaagatgtcccgacaatggcgctaccgccttgtcacacgctctatcagttttatgtcaatgatggcaagctgtctttgcagttgtaccaacgttcggctgacatttttcttggcgtcccgtttaatatcgcgtcctatgcgttgttaacgcatctggtcgcgcatgaatgtggccttgaagttggcgaattcattcatacattcggcgatgcgcatctttacgtcaatcatcttgaccaaattaaagagcagctcagtcgcacgccgcggccggcaccgactttacagttgaatccggataaacatgatattttcgactttgacatgaaggatattaagttgcttaattacgatccttatccggccattaaggcaccggttgccgtttaatcgctagaagacggcaagtcataacaagtgtctgattgctttgtcaggtttaccaatgacacaacaggcgccattttgttcggctttggattgcatactcaaaggaggggtctcgaatgaccgcatttttatgggcacaggatcgcgatggcttaattggcaaagatggtcatttgccatggcatttacctgatgatttacattatttccgggcgcagacagttggtaagatcatggtcgttggtcggcgcacctatgaaagttttcctaaacgtcctttacctgagcgaaccaatgttgttttgactcatcaggaagactatcaagcgccaggtgccgtggtcgtgcatgatgttgcggcggtttttgcttatgctaagcagcatcccgatcaggaactggtcattgctggtggtgcgcaggtctttacggcgtttagagatgatgtcgatacgttactggtgacacggttggctggcagttttgaaggcgacacgaaaatgattccattaaactgggatgattttaccaaagtctccagccgcaccgttgaagataccaatccggcgctgacgcacacttatgaggtttggcaaaagaaggcttaagcagaagccgatgaccggaattggtggttgccagctggtgcggttgtgagttaagacgcatatttgcgtgcacttaaaaaatcgtctctcgtacagaagaggcgatttttttgtcgtttattttaattaattattttacagatagaaataaatcgataagtacatgcacaggctgccgagaatcacaaagaggtgccagataacgtggatgtaagggatgcctttttgcagataaagcatcgctccgcctgtataggccacaccaccggcgactagcagccaaaaaccgactgggcccaaatgatgccacaatggaaccatgccgactaagcaaagccagccgaggacaacgtagatcatcgtttccagatgcttgaagcgattcagaaagaaaagtttgtaggcaatgccgccaagacataatgcccagatggcgattagcagaccaatgccaagtttcccgccaatagcgaccaaacaatatggcaggtaagaaccggcaatcagaatgaagacacctgaatgatcaagtacctgcaaaacatggcgcgccttgctaaaataaaaaccatgaaaagcagtcgaggcggtgtaaagtaacatgagcgaaacgccaaaaccgataagactgaaaagttcaacctgactgccgctattgacgcctttaatgcctaacgcaatggtgccggttacggctaagccaagtgcaaacgcatgggtgatggcgctaaacatttcattgttaaattcataatgacttgattttgacacgcgcattgtttacctcctgatgaacatttgtatgggtggggaagctggcaggcttgcaaccacagcatcgcttaaatcaggaactcgatcgtttggctgctacctgtttattaaaagtttagcatgttgcgttttacaatacaactaaatctagttatgacaactaggtgatgtgtactgacattgtttaagtagtttgctataataatcacgatagacgaacctaacagaaagcgtggctcagacatggcaaatatcaagatcgtcacggattcttccgttcagctgactccagaagaaatcagccaacacaatattacggttgttccgttgaccattatgattgacaatacggtttatattgatggtgaaaccattacgcgggaagactttatggacgagatggcagcagcgcaaaatctgcctaagacctcgcaaccggcgatcggtacgtttaccgatgttttcgataaactaacggcagacggcagccaagtattgtcaattcacatgacagaaaccatcagtggcacggtaaattcggcacgacaggcggctcagctggtaaaaggcgatgtgaccgtcattgattcgcaatttaccgatcgctcaatggcatttcaggtgttggcagccgcagaaatggccgaggcaggtaaagacatgccaacgattcttgataagctcaagcaaattcgtgaccatactatcttagtgttgggcgtgactaacttagataatttagtcaaaggcggccggctcagtcgcgtttctggcttgatttcgtcattcttgaatattaaagttgttttgcaaatggaacatggcgaactgaaggccttgcgtaaaggacgcggcatgaagacgattaataatttcgtgaccgaaactatcagcaaaatggccaagctgaccgatattcaaagtattggcgtatcaacggcaggtgctaaagaaatcggtgaggatatcgggcggcgattagcagaagtcttgcccaacgttccgattctggttcgaccaaccgatccggtcatcgcaacgcataccggacccggtgcctttgccatcacttattacactgattaattttaaaataaatttaaccggccggcgtcagcgtcggctttttttaatgacaatggtatttgggtgacgattgcctgaagtaatgcctcacctatgagtcgggaaccggtgatagggttgcgattgttcgctcgaaaaatacagctgctgaacctgatgcgactagcggagaaacactaaagcagcaacctttgtttattcacgagacctcaagtaaaataatatattataacttgttattcatgtatttatgggaggcaacatgcgtacattaaaaaatttctttatttcctgcggtgtcttgctgctcgcttgtctgctcgcgtttggtggatggcaattattcggaccagtcagttcgccaagtgaagtgaaagttgttgccaacacccccaaacatttgcagttgacggcactcggcgattcattgacttatggcgttggagatgcgactaataatggtggctttgtcggactgactaaaggtgagctggaggcaaccgggcaatatcaagtcaccacgaagaactatggcgtcagtggcaataccagtgggcagattctcactcgcgtcaataagcagcctaaaatccgggcagacttaaaacgggccaatattattacggtgacagccgggggcaatgatttaatgcacgtcttgcaaaagcattttttgacgttgtcggaaaagcaggtgacggctggtagtgttgcatttcaaaaacggctggcaacattactgacaacgattcgcaaagaaaatccaactgcacccatttatgtttttggcatctataacccattttatgtttatttcccgaagatgacggcgatgacgaatagtgtgaaggcctggaaccaagcaacgcaaaagaccttgcagcaatttgatcgcacgtattatgtggatatcgacagtgtgttatccaatggcgaaacagcagcaaacaaggcatccgctaaagaagcgcttaaagaagcgacttccggtgatggcaatccgctgatcttttcacaggatcattttcaccctaataatgccggttatgggcagatgacgaaacagctcatgaagcaaatgaaagcaactaagaaagcgtgggagtaagaagatgcaggcaaagaaacgatcgcttcaaagaaatgcggctaaacaaaaggcggtgagaaccggaattaattggtggaaatggttatttcttattttggtcgggctattgcttggaaccgggatctggtttacgaagaccgcactgatgccagtcaagatcaactcgaccccccaaacgaccatgacatccaaagacccggtatttaccgtcaaagtaaccaaaaacagcgccaatcgaattatggcgcattatctgaaatcatacctgaaggacagcaagatcaaatatgccgtcactttgggaaccaatgaagcagcgttaagtggatcgttcaaatttctagggaatgccgttaagttccagttaacatttgatccgcttgtgttgaagaatggtgatgttttgcttaaagccaagaacctgaatatcggcgcattgccagtaccaatcagttttgtcatgagctatattggcaacagttataaaattccaaagtgggtaagtctagatagtaaggctggtacggttgtgctaaaattgacccaatttaaactccaaaatggcatgacccttaaggcaaacaagttggatctgaccaatgatgatcttgaatttgcggtttatttgcctgatgaagagtgaccattagaaagaagttgaaacaataatgaaaaaagaaacggctatttttgcaggcggctgcttttggtgcatggttgagcctttcgaggagcaacccgggattttgaatgtggtttccggttataccggtggccatgttgccaatcctacctatgaacaggtttcttcgcataccacgggtcacacggaagccgtggaaatcacgtttgatgcggatgtgatcgattatccgtcacttttgaatatttactggcaacaaaccgatccaaccgatgcaatggggcaatttcaggaccgcggcgataactatcgaccggttattttcgtcaaggatgaagcacaacgacaggctgctgaagcttcaaaagcggcgttggaagccagtggtcggttttctgatccgattgtgactaaaatcgaggcagcgaagccattttatcctgccgaaccggagcaccagcaattttatgccaagaatccgcggcggtatgcaatggagcatgcgcagcggcaggcgtttatcgacaaaaactggaaggattaatcatgcatcggactttttacgagtatcttatgacgctgcgtaaccccaatgaccacagcgaggtagcggaatttgccaaaaatgctttcctggatcaaagctttccgaaacatgaaaaagattatcatcggttaagtgattatttagaactcaacggtaattatttaccgacgatggccatttttgacgaaacataccgtgattacgaagccagtgaaagcacaggaggcgattcatatcaataaacacaaggtgccattgtgggcggtcattgttttattcctagttgcgcttggtggcggtgcggcaggtggttatgccctgtcatatcagcaagcacaacagtctgtccttaaaaccggagttcccaaagccttagcaccggtgatttcggcctatgaaacggttacgaataattattataaacaggtcagcacaaccaaactgaccgatggggcgatcaagggcatgttaagttctcttgatgacccatattcggtttatttgcaaaacaatgacaaaaccaatttagacgacaccatttctgcttcatttggcgggattggtgcaaccattcagcaggatcacaacagcctttccattgccagcattctaccgggaacaccggcgaaaaaagcaggtatgaaggtcggcgatgtgctgcttaaagtgaatggtaaagatgtgtctaaaaaaaccgtcacccaagcagttgccaaaattcgtggcaaaatcggcaccacagtagcagtgaccgttaaacgcggcagcaagcaggccaccttctccatgaagcggaaaaagattaccgttgacacggtgatcgggaaacttgcgcctgcgaataaacaggttggggtcattacgatttcgaccttcagcgaaccgactgttaagcaattcaaagcgactgtcaagaaattacgcaaagaaggcgctaaatcctttatcctggacttacggcaaaatccgggtgggatgatgacggctgctttgtcaatcagctcgatgttctccaaaaacggccagaccgtcatgcagattgaagatcgcaatggtgcaaaggaagtctacaaagcaggcaaaaagcttgatggcggcttcaaagtgactgaaaaaaccgcggtgcttattgatggtaattccgcctctgccagtgaaatcaccgcagcagcactgcaccagaacagtcaaattccgctagttggcgaaaagagctttggtaaaggcaccgttcaaaatgtcggcgagatgagcagcaacaaagaactcaagctgaccgttgccaaatggttaacgccagatggcacctggatcaaccacaaaggtctaacgcctgatgtgaaagttgcttacccagcagcagccaaaataacgttaatcaatgcaacccaactcaaacccggtgacaagggcagtgatgtgaaatcgctgcaacagatgctaaaagccttaaagatcggctcagctacggtcaacggtcaatacgatgatgcgacccaggccgccgttaaatccttccaggaggccaacgagctggacgcaagcggtactgccgatcaagacaccttagccgcactggcacaaaagctcagtgctcaactgacgaaggatgatccgatggtagcggctgctgtcaaggaagttacgaaatagttcgtttgaatcaatatcaatgcgcgcgcatgcctttgagggtgtgggcgcgtttttaatctgctaaaataaaaaagataacgaaaggagaaacctctgtttgattgaattagaaggctttgcagtgtatccaaacaaagttgagcgagcaaaagaatggatgtcttttttaaaaggtcatcaagaagcagtcaacgagacccttggccctgagaacatagaagtggaacgtattttttctgtttcagttaatggacggatgtacctttgttggtattctgaacagacggcgcccattcctgatgttacccgcagcactaatccgattgatcaggttcatgtcgacttttggaaagaatgtatcgatgagaaagcaccaaggcttgaatttaagctggagaatgagtttaagcggccaggtgtaaattaagacaattaatgtggaagatttaaatccggctattccgatcgatcaatatagtgcaacgatttatggaaaataaaggggtgaatctgacgacttattggaagtatttgaacacaatagtggtgttgatcgtattttttcttatatctctaatctttgcgagtcacacaatgattcagacacttcttggtgtaggttcgcttgcctggtttttgttttttcttattagagaaatttatttgaataataggcgaacgcaacgaacaaggtttcaagttcgtctctctcatggcttgattgttttgggattacttttattcaatacaagcgttcatcaaactgttatttctacttttggacagactgacatgattcaattttggggtgagcatgaagctgcaattcacatgaatggtagagcataccacttgatatggacaaagaggtcatttcatagcaccacgtatttttataacttgtatgagcgacgaggactgttcttttaccgcgttaattctgaagtcatgtcgtggacaatcaatccccctgagcaaagagattatggtgcagttaggacatttctttatcacggtgaagagcaaggagtaaaatagtgtcatgcacacatacccaaggcacggctgctatcgcctttaagtagctgcctaattcgaacctatttgcaaacgaggagtctaaatgaatgaacaagcgaatttcgccaccaaagttctaacccttcatcaacgactggcaagcgtcaaaatgacgttacctggttgctatcagttggtgaatccatatagcggaaagcagaagcatgcagttgaccagatcacggcagctttttatcataaatattttaatgataatcacaaacggcgattaatcttggggagctcgcccgcgcgaaaaggcactgccataacaggagttccctttgaagatgcagccgagttacaagcagagacaggtatcgctgtggcgaagttccagattaagccatcgtcaacaaacttcttatatgatgtaatgcagcaatatggtggcaagagaaaattttatagtgacttctacatgagctttgcttgtcctttggggttaagtaaaataagtgctaaaggaaacgtgataaatagtaattattatgaaactaacgtgattaaggatagactaatgccattcatagttgcttcattgcaggagcaaatcaaattaggcgtagacacctcagtttgttactgtattggtagtggcgagaattttaaggtgctaacaagtatcaatcagacgtatcatttctttggtagcattgtcccattagagcacccgcgctatgtcatgcagtatcactttaaggacagagcccgctatattcaaaaatacgttgctgccttaaattgtaaataaaaggagtttgaaatattttggcaattcaatggttccccggtcatatggccaaggcccgtaagcaagtacaggaaaaaattaaacaagttgatctgattcttgaagtcgttgatgctcgaacgcctgaatcgtcacgtaatccgatgctagatgaattggtgggtgataaaccgcggcttatcattttaaacaagcaggacttggctgatcctgtactgacgaatgaatgggttcggtattatcaaacacaaggctttgctgcaattgcgattgatgcacaacatgctaagcggctacagcagatcccccaagcggccgcgaagttaatggcggaaaagatagcgcggaaaaaagcccgcggaattcgcaatcccatgattaaggcaatgtgtattggtattcctaacgttgggaaatcaacggttttgaatcggttggttcgaaaaaatatcgcggtgaccggcaacaagcccggggtaaccaagaatcaacaatggctaaaagcgagcgacaactttcaattacttgatacgcccggaattctttggccaaagtttgcctcccagacaatcgggatgcgcttggcattcacgggagcaattgccgacgccgttttccaggaggatgtggttggtttgtatggactgaactattttatggcgcattatccggcggcgttgaaaaaagcatatcatctgactgacacggatctgcaggctgcaccgcatgatgtattggtaaaactaacgaaaacgcaaggatttggtgaggaatttaatcggatggcggaacggctgattttcgatgcgcgccaaggaaagttaggtcgatttacgttagagaaaccgggtgaattagatgccgacgctgagtgagtataaaactcttttacaagctgatcatgttgatcccgcggttttaacggcgctagagcaggatagtcggattggggcgcggaaactcttggcggcttatcaacgccgacaggaccatcaagcagcagaagcggttgcgctacgatatcgtagcaggtatgagcgtaagttatggaaaatgtattcccatgttgcagggttagacgaagtagggcgcggaccacttgctggcccagttgtcaccgccgccgttatcttgccgcatcagtttaaatggccggtgaacgattctaagcagctgacagcgcatgaacgtgatgtcttgtatccgcatattttgacggaagccattgcggttggtatcggggtggcagataatcacgaaattgatcgggaaaatatttaccatgcgacggagctagcgatggcacaagcagtttcgcatttgcgggttgccccagagtttttactggttgacgccatgcatgtccccgttaatttgccgcaagaacggctcatcaaaggggatgccaatagtatcagcattgcggctgcaagtattgtcgccaaagtcattcgggatcgcttaatggtgatgtatgatcgggtttacccgggctatgattttaaagacaacatgggttatggtacgaaagcacatttagccggattagctactcatggcgtgacgccgattcaccggcgcagttttggaccggtacgacattgtctgaaatcctagatgtttcttaaaatattcgcgtaatgttcaagtaggaggaagacagcatgacattacgtgattttttattagcatggcacttggccacccatcagaatccgcgcttggcagttagtttacagcaagccattttgaaaaaagctgatctaagtacctatcaaaatgacctcaaacagaaattaacgccagcagttgcacggatattaagtgcagcacgcgagaccccgtatctgacgtttgttgatactgcctatcctccgcgcctgcgcgaaatcccgcagccaccgtctgtcctcttttatcaaggcaatctcggcttaatcaatcaattaactttaggggtcgtcggttcgcggaaggcaaccaactattcagctgaagcactgacgcgactgtttccgcaattaccgcctatgacaattgttagtgggttagccgctggtgctgacagtatggcgcatgaagcggcacttgcagccggactaccgacgattgccgtgattgctaacggcatcgatcaagtgtatccggctaagaatcgcagcttacagcgacaaattagtcgggtgggattggttgtaagcgaatatcctccgggaacagcaccgcaacgctttcaatttgtggcgcgtaatcgcatcattgccggtttagcgcatggcgtcatggtaaccgaagccgaaattaaaagcggcagtctgattacggctaactatgccttgcaacataatcgcgaagtttttgcgctgcccaatcggtttggcgatgtgctaggtgcaggcaccaacgcattaattcaagcaggggccgccattgtcaccggtccggaaaccttaatggaaaatctgcatttttacccgtaaagtgtcaaaatctgcttactttatagtagaaaaattttcgtttgatttgacaagagcaaaatgactagcttatgatagcaactgttttgagccagcaggcaagatggcacccgttttaagcagcgagacgcaccgtaaattttttgcctagctgaaactcatgaagcgttgacggtgaatcgtcagcctgcacaaattaaacagggcttgcttattgtagcaatgccaccggaaggagcgcgttcatggccgacaagaagttagtcattgttgaatcgccagccaaagccaagaccattgagaagtatcttggtcgcacctataaagttgttgccagtttaggccatatccgtgatttacctaagagtcagatgggcgtcgatgttgaaaataactacaaacccaagtacatctcgattcggggtaaaggcgatgtgattaaatctttaaaaaaagacgcaaaaaaagccagccgcgtttatctcgccgccgatccggatcgtgaaggagaagcaattgcctggcatgtcagtcatatcttagggcttgatccgaatgccaagaatcgggttgtttttaacgaaatcaccaaagatgccgtaaaaaatgcatttaaaacccctcgtggtattgatatggatcttgtcgatgcgcaacaagcacgccgaattctcgatcggctcgtggggtactcgatcagcccgctgttgtggaagaaggtcaaaaagggcctgagtgccggtcgggttcaaagtgttgcgttaaagctcatcattgaccgtgaaaatgaaatcaagaactttattcctgaagaatattggtccttggatgccgaattccaaaaaggccgcagcaagaaattctccgccagtttttatggcatcaaaaacaagaaaatggcgctgaagaacaatgaggcggttcaaaaagtcttaagtcagattgacaagacgaagccgttttccgttaccaatgtggttaaaaaagaacgcaaacgtttccctgcaccgccatttaccaccagtaccttgcaacaggaagccaaccgtaagctaggattccgcactcgtaagaccatgatgttagcccagcagctctatgaagggattaacttaggcggcaagttgggtacggttgggctcattacgtatatgcgtactgattcaacccgggtttccaacgttgccaaaaccgaaacgagtcattatttgcatgaaaaatatggcgaggcttatgccgctgtcaaaattcgccaaggtaagcttcaagaaggggctcaggatgcccacgaagccatccggccgacgagtacgttacgaacaccggaaagcttggcgtcggttttagacaaagatcagatgaaactgtaccgtttgatctggagtcgctttgttgctagcgaaatgacgccggcgattattgacacagtcgccgtcacgctcaatcaaaatgacgtgacgttccgggcaaatggcagccaaatgaagtttgaaggctttaccaagctatacgtttcctcgcgtgatagcgatgaaaaggataacgttttaccaccgcttgcagtcggcgatgctgtgaagatgctgaaaaccgatccggcgcaacactttacccaaccaccggcacgttattctgaagccaacttggttaaggctctggaagaaaacggggttggccgcccatcgacgtatgcaccgaccatcgaaaccattcagaagcgctattacgtcaaactcaacgcccgccgctttgagcccacggaattaggcgaaatcgtcaatagtttgatcgttgaatttttcccggacatcgtcaatatcaagtttacggcgaatatcgaatccgaacttgacagtatcgaaaccggcgaagccaattgggtcaaagtcatcgaccaattctataagccgtttgaaaaagaagttgcgcacgccgagaccgggattgaaaaaatccaaatcaaggatgaaccggccggctttaactgcgatatctgtggcgcgccaatggtgatcaaaatgggacgttatggcaaattctacgcctgctcccgattccctgactgccgtaacaccaaagcgatcgtcaaagaaatcggcgttatttgtcctaagtgtcacaaagggcaggttgtggaacgcaagagcaagcgtaaccgcgtcttttatggctgctctcgttaccctgactgtgactttgtttcctgggataaaccggtcggccgcgactgcccggtttgcggacatttcttagtcgaaaagaaatctaaagccggcacccaagtcgtctgtcccaacaacgattacaaagaagccttacaaaaagcataaatcacctgacagcaagtacggatcctttgtacctgctgtttttttcgggtacactaaggcaaagtgcgagcagaatcgcttaaaaataaccaaacacaaccaagataaacgtcttaagatcagtgatccattcaatcaaattaataacctcaccaaggaggaattcatgatgcctactgttaacgttattggagccgggcttgccggttcagaagctgcctggcaaattgcccaagccggcgtcgatgttaatctctacgaaatgcgccccgtgaagatgacgccggcacatcacaccggtaattttgccgaactcgtctgtacgaactcactgcgcgctaatcaaattactaatgcggtcggacttttaaaagaagaaatgcggcggctgcattccattatcatgcaaagtgccgatgcaaccgcggttcctgccggtggtgcgctagccgtggatcgcgagccgttttccgagctggtgacccggcagctgacaaaccatccccatattcatgtcattcatgacgtattaaccgattttccggctggcataaccgttgtagcgaccgggccattgacagcgccgggacttgccgatgcgattgttgcgttgaatggcgaagcaggcttgtccttctttgatgctgcggcgccgattatcgacgccagcacgattgataacgacatcgtttataaaaaatcgcgttatgaccggggtgaggctgcttatttgaattgcccgatgaataaggaagaatttcaggcattttacaaggcgctggtgacagctgaggttgctgaaggtcacgattttgaaaagatgacggtgtttgaaggttgcatgccaattgaggtaatggccaagcgcgggatcaaaaccatgctatttggtccgctgaaaccggttggcctggaagatcccaaaaccggcaagacgccatatgcggtggtgcagttgcgtcaggataatgctgcagccagtctttataacattgttggttttcaaacgcaccttaaatggggtgagcaaaagcgggttttccgcatgattccgggtctggaacatgctcagatcgtccgttatggcgtcatgcatcgcaatacatttatgaaatcgccagtggttcttgagccgacttatgcgtccaaacgccgcggtgatctcttctttgccgggcaaatgaccggggttgaaggttacgttgaaagcgcggctagtggcctgattgccggtaccaatgcggcgcgtctggctttggggcaaacgcccatcgcttttccgcaaacaactgcgatgggggctatggcacactatattacccacacctcgccaagtcactttcagccgatgaatgctaattttggtattatgccgccgttagcagtcaaggttcggaataaaaaagaacggaatcaacaactcgcagagcgcgcattgaatgatctggcaacttttcaaactgaattacaaggcgcacatcagtcctaaaattggaaaatgatctcgggtaaccgggattttttcatgatcacgggtcgtcatgttcgccaagtactcaatgagcgaataatggtggcggattgcagtttttttagcccgtcttcgcctatatttacggcaggtttagtggctgaaaacgtcaacaatcgttctttttatgttaatctattaagcggagggatgtcgtgatgaagccacttgcagcgtttcaggaatacttaaccgttgagcgccagtattcgccggaaacggttacggcctatttaaacgacattcaggaattccaggcttttcttaaggcgaatggtgggtttaccgactttagcaaagtggacgacttggacgttcaaacctatttaacggacttgaacaagcaggcgttggcgcgaacttccattgcccgtaaaatcagtagtttacggagcttttatcggtatcttgttcggattgatgttgtgaaacgcaacccgtttgaattggttgagttaaaaaagcagcatcatcatttgccgcagtttttctatgaggcggaaatacaggaactctttaaaacggtagaaggaaaaaccccgttggatcaacgtaatcgggcattactcgaggttttgtacggtaccggcattcgtgtctccgagtgtgctaacttgacgttgaatcaagtggattttaataccggcttattgctgattcacgggaaaggcaacaaggatcgctatgtgccgtttggccgctatgcccagcgtgcgttgcagacctatctcaaagacggtcgccagacactgatgaacaagcgcgatgtccagcatcgatttgtgttcgtcaaccagtatggtcgaccgattactgcacgtggtattgaatatattttggatcaattaatcaagcaaacgagtctgatcgcgaatattcatccccacatgctccgccatagctttgccacgcatatgctggatcacggggctgacttgcgcacggttcaggagttactggggcacgcgagcttgtcaacgacgcagatctatacccacgtgacgatggcgcatttgaaaaacgaatatatgaaatattatccgaagcataattaagactaaagcatgatgtaattgcacgatgaattttttaaagtatgaacattggcagatttaacaacactgccagttctgattgattatccgatatcaagaaacaaaaaaggagcataccatgacaacaattgcagcagtgagaaaagatggcgtgaccgctttagccggcgatggccaagttactttgggcgaaaaagtgatcatgaaaggcaatgcccaaaaggtacgccgaatctatcatgatcaggtcgttatcggttttgccggcggggtcgccgatgcgtttacgcttcaagactggtttgaaaagaaactagagcattattccggtaacttacgacgttcagcagttgccttggctcaagactggcgtaaagatccaaccttgcaaaaactcgaggccatgatgatcgtcatggatgagcatgatttgctgcttgtttcagggtctggagaagtcattgacccagacgaggacgtggtggcgattgggtcgggcggtaattttgcccaagcggccgcaattgcaatgttgcggcattcaccagacatgacgccggctgatattgctaaagaagcggttaatatcgctggtaatattgacatctttacaaatcataatattatcgttgagagtttctagggcgttcgttggtgcagaggtctggatgtaaaggcttattgcgtgctggctcacgctccgtaacgcgttcaccggcgcagaagtctgcgtgtaaggcccttaggcgcaatggccaaagcccggccatcacgcctaaggccacttacactccgacttctaagcgcgtcggttcacgctcactttcttttaggaggttcccatggtagaagtacaaacaccgaagcaaattgtagaaaagcttgatcagtatgtgattggtcaagatgaggcgaagcgggccgtggcggtggctttgtataatcgctatcggcggatgcagttgtcgccgaagatgcaagaagaaatcacgcctaagaacttgctcatgatcgggccaaccggggtcgggaagactgagattgcgcgccgcttagccaagatcgtggaagcaccgtttgttaaagttgaagcgactaaattcactgaagtcggctatgttggccgtgacgttgaatcgatggtgcgcgatcttgccgaaacggcggttgccatggaggaagaaaagcagtttaaaaaagtccgggttcgcgcggaaaaagaagctaacaagcggctggttaagattttggtaccggctattcgcaaagaaaaaaatagcaatccgatggcggaaatgatgagtatgttgcaaggcatgcaaaatggcaagatgcccgcgggtgacgatgctgatgctggcggtgaagtgacggatgacattcgcaatcgccgtttaagcgtggcggagcaattggaaaaaggcttgttagaggatcgtgaaatcaccgttgccgtcaatgacgagaaaaaaggcggcggcatgagtgatatgtacggccaaatgggcattgaccttagtgacacgattggcgctttaatgccgaagaaaaaagttgaacgcacgatgaccgtcaaagaagcacgcgaaatcttcattaaagaagagtctgataaactggtcaatcatgccgatatttatcatgatgcgattcaaagcgcggaaaataacggcatcattttcatcgacgaaattgataaaattgcagccggtgataaacacacgagcggtgaagtttcccgtgaaggcgtgcagcgcgatattttgccgattgttgaaggctcacagattaacaccaaatacggaccgattaatacggatcacattctgtttattggctcgggcgcgtttgcagaagccaagccaagcgatttgattgctgagttgcaaggacgttttccaattcgcgttgagttaaaagatttaacggaacaagatttcgtgcggatcttgaccgagccggacaatgcgttgattaaacaatacattgccttaattggcgcagacggggtcaaaatcacgtttacgaaagaggccgttgaacgtatcgcagaaatcgccactcaggtcaaccatgataccgataatatcggtgcccggcgactggcaacgattctcgaaaaactgttggaagatgtgctttatgaaggtccggatatggcgatgggcagcgtcacggttacccagcagtatgttgacgacaagattgggcatatcgccgcggatagcaacatgacgcgctatattttgtaaggtaactttgaagaactgttaggtaaaggatgagaatgtatggtaacgattgcaaatgactttttaacggttaacatcagtcggcatggtgctgaattgaccagtattaaggataatctgactggccgtgagcgactatggcaggctgatcctgaagtttggccacgccatgcgccggttttatttccgattgtcggtgcattggctgatcagcaatatcattacgctggcaagacttaccatatggggcaacacggatttgcgcgtgatcgtgactttacggttgtgtccgcaacgccttttaaagccagtctcgtgctcaaagatgatgacaaaacgcgggcgatgtttccgtttgcttttcggctcatcattacctatgcgctagaaaataataacctgcacgtcacctaccacgtcgataaccccgctaaaacggaaccgttatacttcagcatcggtggacacccgggttttaacgttcccatgacgccggataccgaatttgcggactattacatgaacttcaagccgcgtaagtctctggtgcagattccgcttgtcgctgggcaaggtattgattacagtcatcgaactttggctgcgaccgatgccaacctagcgctgacacacgaaacgtttaaaaatgatgcgcttatttttgcgccgcttggtaaaaccaccttcaatttactttctgatgaaaccaagcacggagtcagtgtgaccatggaagacgccccttaccttggtgtttggagtccataccctaagaccggcgattttgtctgcatcgaaccgtggtggggcattgcggatacgatcggcaccaccggagatctgaccaagaaactcggcatcaaccgtttggaaccgggaacggcttttgagaaaggttacacgattagcattttctaactgattaacgaagcttgttgtgccattacaaaaagacatccgctaggggatgtctttttgattgtcaggtatttgggtgattattcatgatgacgctgattgcgcaggtataggccgagcccaaacggtaccatattttcgtcaccggccttgatgcgtttgaaattggcgcgatgtttgatgaaaaagacaaccagtaagccgcaagcaactgtcgtcagtagccaatcgtgatacaccaatgaccagcacgtgataatcaccatccccagcgtactggccacactcaccatggacgttaataagatcaggctaaaccagatggcaaaggcgatgaagaaaaatggcgggttatacgctaacaaaataccggcactggttgcgacagcctttccgcctttgaaaccaatgtagatcgaaaaagtatgccccaataccgctgccaacccgacaaccaagattagccagtggtggtcaatcccaaataaaatcggtaaactggcagacagtgttccttttagaatatccaatagcaagactagggtaccgccgaccggtcctaacatccggtaagcattggtggttccgatattatggctgccaccttggcgaatatccgtatgataaaatagtttgccaacgaccaccccaaacggaatggcgccgatgaaataggcaagtataaaacaaagcacaagtaccaaatgtgcccctcctctcagactaaaaactattttagcatttttgacttttgagggatacgccggtaaaataatacgaacacacattcgatctgtgaactatattgcatcttgacagcttcatacaggcgtttttgactgtgatattttgccggtgatcacagaaattgggttttcttaaacgttcctgcgctcgccctccgcttctgcgtggtgtattctataaattagttgtttcaaaaagggagtttattatggacaaagcaacgcaagcatataatgattcatccattcaggtgctacacggattagaagccgttcgtaagcgtcccgggatgtatattggttccaccgatagccgcgggttacatcatttggtttatgaaatcgtggataactcagtcgatgaagcgctcgcggggtttggggatgaaattaatgtcacgattcacgccgataattctgtgactgtgcaagatcatggtcgagggatgccaacgggaatgcatcctagtggtaagccgaccatcgaagtcatcttaacggtgttgcacgctgggggtaagtttaaccagaatagttataaaacatcaggcggccttcacggtgtcggctcaagtgtcgtcaatgcgctgtctgagtcattgacggttcgggttgtccgggacaaacacgcctttgaagagcattttattaatggcggacatcctgatggcgggttgcagaagttgggcaaggttaacgaacccaacggcacgaccatcacgttcaagccggatccgactgttttccagaccacggttttcaattacgataccttagccgaacgactgcgcgaatccgcgtttttgttgaaggcgatcaccattaatttaaccgatgagcggaccggtaagcatgatcagtatcattatcctgatggtttggttagtttcgtgaaataccttaatgaaggtaaagacgccttatcgcaagtcattaattttgaaggcaagaaggacggcattgtcgttgattttgccggtcaatacaatgatggctactctgaaaacattatttcgttcgtcaacaatgttcggactggcgatggcggcacgcatgaaatcggattgcgcagcgggatgacgcgtgcttttaatgaattcgcccgaaaagtcgggttattgaaagaccgcgataagaatcttgaaggcagcgatgtccgcgaaggttttgcgggtattttgagtgtccgcatcccggaagagatcttacagtttgaaggccagaccaaaggcaagttggggacgcctcaggcacggaccgttgtcgatgggattgtgtacgaccaccttgccaccttcttgatggaaaacggtgaagaatcgcaagaactcgtgcgcaaagccattaaagcccgcgatgcccgtgaagccgcccgcaaagcccgtgatgacagtcggaccgggcgcaaacgcaaaaaggatcaggggctgctttccggtaaactgaccccggcacagaccaaaaaccctaaacgcaacgaactgtatcttgtcgaaggggattccgccggtggttctgccaagcagggacgcgatcgtaagttccaggcaattttgccattacgcgggaaagttttgaatacgcaaaaagccaagttgcaggatatcgtcaaaaacgaagaaatcaataccatgatttataccattggcgccggtgtcggagccgattttgacatccagcaggctaactacaataagatcattattatgaccgatgccgatactgatggtgcgcacattcagatcctgctgttgaccttcttttaccgatacatgcggccgttaatcgatgccgggcgtgtgtatatcgcactgccgccgttgtaccgcttgcaaaaaggtgctggcgctaaaacgaagatcagctatgcgtggacggatgaagagttagctaaggaaaccaaggcgatgggcaaaggctataccttgacccgctttaaagggcttggcgaaatgaacgccgatcaactatgggagaccacgatgaatcccgaaacgcggacgctgattcgggttcggattgacgatgcgcagctggcagaacgccgggtcacgacattgatgggcgatcgggttgaaccgcgacgtgaatggattgaacatcacgtgaagtttgatctggatgatgaaggcagtatcttggaaactccaacggcaaaccatgaaaagttgcaattcggagctaagcaaatcgttaagcaattagataagaaaaggaagtaaaagccattggccaatcagattcaagagttgaccttagaagaggtcatgggcgaccggtttggccggtactcgaaatatattattcaagaacgcgcactgccagatgttcgtgacgggttaaaaccggtccaacggcgcattttatttgcgatgaaccaagacggcaacacctatgacaaaggatttcgtaagtcggctaaaagtgtcggtaatgtcatgggtaattaccatcctcatggcgacagctcgatttacgaagcgatggtgcggcttagccaagactggaaactacgcgcaccgttaattcagatgcacggtaacaatgggtcaatggacggggatccgccagcagcgatgcgttatacagaagcgcggctaagcaagatcagtaaggaaatgttggcggatattgataaagaaaccgttgatatggttttaaactttgatgacactgcccaggaaccgactgtgctgccagcgggttttcctaatctactcgtcaacggtgctactgggatctctgcagggtatgccactgaaattccgccacataatttgcgggaagtgttcaatgccattttgtatctgctaaaacatccgcaagctgatttagccgacttgatgcagtatgttaagggacccgattttccaaccggcggcatcatccaagggcttgacgggatcaagcaggcatacgaaaccggccggggaaagattgtcgttcgctcacgcacccacattgaaaccattcgcggcggccgcgagaagattgtggtcactgaaattccgtatgatgtcaacaaggcccaaatgatcaaaaaaatcgatgaactacgacttaacaaaaaagtcgacggtatcgctgaagttcgcgatgaaagtgatcgattcggcttaagtgttgtcattgagctgaaaaaagaagcggatgcccatggaattttgaattacctcttcaaaaataccgatctgcaaatcacatataactttaatatggttgcgattgccgatatgcaaccgaaattgcttgggctcaaggcgatgttggaagcttatgtggcgcatcgccgtgatgtggtcacacgccggacacgttatgagttaaacaaagcgcaggcacggcagcacattgttgaaggcttgattaaaatgttgtccattttggatcaggtcattgcggcgattcgtgcatcctcagataaaggggatgccaaacgcaatttggtcaaacaatttgatttttccgaagcgcaggctgaagccattgtttctttgcagttatatcggttgacgaataccgacattaccgctttgcaggacgaggcggcacaactggccaaggcgattgccgaatatcaagacattctagcgcagccggcttcgcgtgatcgggtgattgaaaaagaacttaaacggattgctaaagagtacggggatgatcggcgcagcagtattcaagccgagattgaaacgctcgaagtggcaacgacggtcacagtggctgatgaaaccgtgatggtccaggtgtcacgcgacggctatgtcaaacgcagctccttgcgtagttaccaagctgttgatcctgaagataacggtttaaaacccaatgatttggcgatttttaccggagagttaagcaccctgcaacatctttacatcgtcacgaatgccggtaatatcatttatcggcccgtttacgaaattagcgatgcgcggtggaaggacactggggaacatttaagccagacagttggcttgggaaccgatgaaaaggttttggcggtctttgcttttgatcagctagatcttgctggtacctttgtccttggctccagtgacggctacattaagcagacggcattgagtgatttgcagccgcagcgcacgtataaacgcaaaccaatgatggcaatgaaactgaaaacaccgggtgccgtggttaccaacgcttacttcacgaccgatcaagcccaggatgtttttgttgtcagccgacatgcgtatggactcgacttcccactggatgaagtttccacggtcggtgcccgggctactggggtcaaaagtatggatctcaaaccggaagatgaggtggttaactttatcttagttaagcagccagaaaaagcagtggtgggcattttgactcagcgtggtgcgtttaaacgtatggcgttaagcgaagtcggtcaaatgagccgtgctcgccgcggattgcttgttttacgcgaattaaagcgtgatccgcaccgcattgtcgccatgatgcaagtcgatgacaacacgcgtctggacgtgttaaccgatgccgataaagtgatcacgttaacgcctgtgaaccacccgacaggtgatcgctactctaatggttcctttgtgattgatactgatgtccaaggaaaaccggttttcgtacgcacacgtgaagaaacaccggttgaaccgtaacacaaaaaattctccatctgtattaatacagatggagaattttttatttattatatgacagtacggttgtgcacaacttatcaagctaatgattaagctttttttatgaaacaggaaagtacaccgaaaaaaacagcaaaacgcctgttatatcagcgataaaacgcttgcatagatttgccttcgtgttatactgagtttgtaagaactgtcacatctgtaattcactttaggaggcaatacctatgaaacagcttgacgaaaccaaagttcctaattattgggaaggctttaacggcggcgactggcaagaagaaattaacgtgcgcgattttatcgagcataacctgaaccaatatgatggggacgagagtttccttgctggccccactgaagcaacgactgttttaaataatcaggttttgaatctgaaaaagcaagaacgtgccaatggcggtgtactggatgcagataacaatattccatcgaccattacttctcatggccccggttatctgaataaggacctcgaaaagattgtcggtgtccaaaccgataagccgtttaagcgagcattcatgccatttggcggtatccggatggctgaggatgctttgaaatcctatggcttcgaaaccgacgctaatgagcacaagatctttaccgaatatcgtaagacgcataaccaaggtgtttttgatgcttatacgccggaaatgcgcaaagcccgccactataagattgtgaccggcttaccggatgcttatggtcgtggtcggatcgtttcggacttccctcgaattgctatttatgggattgaccggctgatggctgagaagttcaacgattacaacctgaccggcgatggcgagatgacagatgatgttatcaaactgcgcgaagaaattaatgaacagtatcgtgccttgaatgacatgaagaagatggccaaagaatacggctatgacatttcccgcccagctgctaatgctcaagaagctgttcagtggatctacttcggttacctggcagccgttaagacccaaaatggtgcggcaatgtctgtcggccgtatcgatacagtgattgatgcctatattcaacgggatatgcgtttgggcaagctgaatgaagagcaggcacaagaactcatcgatcatttggttatgaagttacggatggtacgtttcattcggactgaagaatacaactcactgttctccggtgatccgatctgggcaacactgtccttggcagggatgggtaatgatggccgtcatcatgttaccaagaccgcgttccgcttcctgaagaccttggacaacatgggcgcggcaccggaaccaaacatcaccttgttgtggagcgaacgtcttcctgaagggttcaaacgttatgctactgaagtgtccatccaaagttcaaccattcagtacgaaaacgatgatctgatgcgcaacgaatggggaaccgactattacggcattgcttgctgtgtttccgcacagccaattgcagatggtgttcagtacttcggggcgcgagcaaacctagccaagaccgtgctgtatgcgatcaacggtggtaaggacgaaattcaggaagcacaggtgggacctgaatacgagccgatcaccagcgactacattgactatgacgagttcatgaagaagttcgacaagatgatggactggttagcagatgtctatgtcaatgccctgaatgttattcactacatgcacgacaagtactactatgaagctgcgcagttggcattgaaggatacacgtctgaatcggacgtttgctaccgggatttccggtttgtcacatgcggttgattccatcagtgccatcaagtatggccacgtgaaggcaattcgggatgaaaatggcgttgcaatcgactttgttgctgacaatgatgactatccgcgttatggtaacaatgatgaccgggcagacaacattgctaagtggttggttaagaccttctacaacaagatgaatacacatcatctgtatcgcggtgctaagctcagtaccagtgttctgaccattacatcaaatgtggtttatggtaagaataccgggacaacaccaaacggccgtcagaagggcgaaccattctcacctggagccaacccagcgtatggcgctgaaaagaacggtgctttagcttccttgatgtcaaccgccaagatcccatatcactatgcaacagacgggatcagcaatacctttggggtaacaccgaacaccttaggccatgacgatgaaactcgtaaggacaccttggttcacatggttgacggctacatggaaaatagcggcatgcaccttaacatcaacgtcttcaataaagaaacgttgattgatgcccagaagcacccagaagaatatccaactttgactgttcgagtttccggttactgcgtctactttgcagacctgaccaaagaacagcaagacgatgttatcgctcggaccttcttcgacgaaatgtaatcaagtcaatctattcgcaaaacaggagatcattcctgttttgtcaaaaaacggcaacgatgctgttgccgttttttgacaaactgaaatgaaaatcgttgaaaattaggtatttatttgcactggaggcggcatagatgaaactcatcgatcaatcacaaagcccgttaaatattttggaacaagtgggacaggatcatgaaggcccaataaagggatacgttcattcagtcgaaagctttggttcggttgatggtcccgggattcggtttgtcgtctttatgcaaggatgcaggatgcggtgccagtactgtcacaaccctgacacttggaatatcggtgtgggcgaggaaatgaccgctgatcagatcctggcagatgcacagcgatataaagccttctggggtgaacaaggggggattacttgtagcggtggcgaaagtctcgtccaaattgattttatcctggaactttttaccaaagctaaggaactgggtatctcaacttgtttggatacttcgggtggtccattcacccgcgatcagccgtggtttggtcaatttgagaaactgatggccgtcacggatatttcgttggttgatatcaagcacattgattccgcggaacacaaaaagctgaccggtttcccaaacgaaaacattttggatatggttcagtatatgtcggatcatggcgatgatatgtggattcgccacgtacttgtgccagaacgaaccgactttgatccttatctcaaacgcttgggagattatattgccactttggataaacgcgtggtccagaaagtggaaattcttccgtaccatacgttaggggttaagaagtaccatgaactaggtattacgtatccgctggaaggtatcgagccgccttcagctgatcgggtcaagaatgcagagaacttgctacacgttgaggactatactggatggcaaagttggcgaccacagccagctaacaagcagtgatttagttgaaacttaacgtaacgattaaaaacgcagcaaatccgttgcgttttttttaaatgccacttatgatgatggttgagtaacgttatcaaattataaacgaaagggaagccgccctatgaagacgaaacaagagcgcattttttcctccaaaactctcacgtattttttgcaattagcagaaaccatgaactacacccagtcagcccagttgttggggattacccagccggcactgacgcagcaaatcaagaaattggaacgaacagtgggggcaccattgttttattccgttggtaagaagttgcatttatccgatgccggtcgcacgatgttgaaggcgacacacgagatttatgaaattttgaaccagacgactgacgagattcagcaaagtaccagtgccacagtcggtaagattaatattggcttgttaagttcaattgaagacagtgcgtttaatgcttttatcgcgcactactatgatcttaatcctgaagtagaaatcacgttgcgaatgatgacacgtcatgagatctgggaagcattggagaacaaccagattgatttggccatcatgaatctgcctgatgagacgattaagaactggaaaccgtatgccagcaagaagattcttgatgaacagttattgttcctgcaccatgataattccctggctaatcgcaaacgcctgcatttcaaagatacgctggctgagccgtgggtaacttatccagacgactatttcctgggtcagttgttgcatgaggcatataagaatcagatggttgattttccgcatgttgtggcgcattttaccacgccatatcagttaactcagtttgtcaaccataccggtgttaacaccgcgttaccaaccagttttgttgccgctcatgctgatcaaatcaaggcgcatgccgttgcctttgaaccagcgattcgctttgagacctcgtttgtgtatcgcaaggaaaaagctgatattccgcggattgccaacttctttaagacgtttgacgcacatttatctgagaaagattatctatcgcgggtcagcgaaaacagtggtaaaattgaaaggtaaactattcagctgaggagcgatcagataacatgacgactttgatttttggacatcaaaaccctgatacagacgcgattacaagcgccatgagttgggctgaatttcagaagcaagcaggtaataccgatgttgaagcagtagcactcggtgaaccaaacgatgaaaccaagtttgtattggatcattttaaggttgctgcgccgcgggtcattaagacagccgcaaatgaaaccgggcacgtaatgttggttgatcataacgaattccagcaaagcgttgctgatatcgaagacgtgcaaatcgattcagtggttgatcaccaccgcattgccaacttccatacggcgtcaccactatattaccgggcagaaccagtgggcagtaccaacacggtgattttcgagttgttccaggaacacggctatgaaatttcaccaacactggcaggcttaatggcttctggcttgatttcggataccctgcttctgaagtcaccgactgcaaccgacaaggacaaaaagatcttgccggaaatggctaaaatcgctggcattgacctgcaatcatacggtttggctatgttgaaggcgggcaccaatctagctgccaagtcggatatggatatcattgaaggcgatgcgaagagctttacgatgggcggtaagtctatccgtattggacaagtgaatacagttgatcttgatgatatttatgcgcgtcaggatgaattggtggccgctatgaccaaagaagcacaggcgaagggctatgatgacttcctgttaattgcaaccgatattctgaacagcaattcaacgggctttgctgttggcgcagatcgtgacaaagtggccgcagcattcaacgaaaagtttgatgccaatgaccggttggcactgcctggcgtggtttcacgtaagaagcaggtcgtaccgccaatgcaaggtgcgtttgaaggttaattttgaacttaataattggttttataaatcgcagccgtttgtggttgcgatttttttgtgctcaaaaacttggaagaacaaaaaagtcgaatttttagatctgaaggtgcagaaatgtgattattgcgaaatttttcagtaagaatagttcaaatttaaaacgaggtgcaaaaaacgcagccttataactacttcgtataatatatattatgtaaactagaatggagattttgagtcgttgactttgacgtgacttatttggtgttcaaatggcaaaacgattgatgcaagtcccctcacctgacagacagctcaaaaacttttgagagaagcaaatcaattgtacggatgtgagcggtgcgctttatttgtttttttctggtttgaaaatgaccagtcgttgctaaatatatgtaaattcagcattaatcaaagcagatttgtagaaagtatcattttgagtcataaacagcattcaagtcgcaagtgttgctgtcagctgaattctggatcaaaatacgaaaattgatttgattgcagccaatgaatcgttggttaattggttaaactgttgctaaagcggcgccgtggaatcaggacatcagcacagatgtcctgatcgtgcagtgaattcaaatttgaaatgcaactaagtttagtgtcaaatgacagatcaacaaatttggtgatttagctggcttgatgattagaagcccatttacctttggataatactaaaactttattcagttctacactggtgcttttttcggcgcatatcgttgcgaattaccgatattttcgtcattatccctcgccacgcactggttttttcgcgtatactgaaattatccaaaagaaaacatatgttcgaggtgactttatttgtcgacacagaactaccctaaattaatacaagccatgctaccttccctgccggactatattcaggattactatcacagccaaaaagcaattcccatcgcggattctaccctttaccagtacctgcacttttaccaggaatttctgcattggcttatttccagtcgggtcacggatgccgtttcgccacagaatgtgcctttgaagaccttagagcggctttccttgcgtgatgcgcaggcgtttgtggcgtatttacttgagcggccgtcgaaaacccatccgaataaacgcatgacgcggcgcagtgttgcgttacgactggtcgggatcaaggccctttatcggttcttaaccgaagaaagcgaaccaaatgcagacggtgagccttatttttaccgcaatgtttggaataaggtgaaacttaagacccatgcggagacgacgacttaccgtaatcataaactgcaggaaatgttgtttgtagatggcgaagatgcgcgctttttacagtggctggatcggcaatatgctcagcagctgccatcgaaaccgcgcgcttattttgaggcgacgaaggaacgaaatttggcgattattgcgctgctgtttggctccggcgtgcgggttagtgaattggtcaatatgaatttggaagatctcaatatggatcgtcatactgtgcaggtggtgcgtaaaggtaattttcaggatcgcgttaactttgctgactggattgatccttatttaacggcttatttgaagtcccaaaccgcgatgattgggcaccagaagcctacttctccgctatttgtgacgcaaatcggccaaacggtgaaccgcattcgccaaaatacgattgaagcattcttcaaacgctatacaaccgcttatggccgcccatcaacaccccataaagcacgccataccttgggaaccaatatttataccgtcaccaaggatgtgcagcaagttgccgatcaactcggacaaacgacgaccagcgctacggatctgtacatcaatctcagcgataaaagtggaaaagcggccttacgcgaagtttcggaaactgccgccaaagccgtggatcaacatccccagcaaccataatgtcggcggttagttgtctggttaagtcatgttgcggcgctaattaacgttacagtattcagtgagataacagtggcgacattttttgatgctggttgacatagaaaaaagctacctgatcgcctttgatgacttgcgatcaggcagcttttttatgctctgcatcaggccgccctcacccacggctggatggctgacggcgggaaacaattcgataataaacgttgccagtcaagcggtacatcagcacgtagatgaccgcaaaaattgcaagcgtgattaacgaaacggttaagaagaattgccaatccggcaggccgaatagcatcataatacgttggacaaagggcaatgcaaagcccacgtggatggcagcgacgatcaaaggcaggtaaaacagtgtgagtagctgactgttaatggtagcgcgaacttctcgaaggctcaggccgacgcgttgtaagatggtatagcggcgtgcatccgcgtagccttctgccaactgcttgtagtaaagaatcagcaaggttgccaggatgaaggtcaccccaaagacaaccccaaggaataggaaactgctcatcatgctggcagtatcatcgtaattagcggctcgcgactgaaccgattccggtaatgcaatcccacttttgacgactgcatgataaagtttgacctgattggcgtgactgccgcttaatgttacgtcttgattagtggtcacgtcggctttgagcagtgccattgacctttttggataaagcgcgtgtaaagcggttaatagttgtgcgtcagatggaagcgcgacaaacaagttaggaataaacgttttaggcgcatttggaaaactggtgacttgtttggcgacgtggtaagtctgtttgccaatacgcaacgtcgcgggttggtaatgattggaggcatagattaaaacctcatcatgattaagagccacatgtttgccagtatagcgattataattttcgacggtcatcagctgaaccgaacgggcattattgaagctaaacgggccgttaaagttagcttgagaatctaacttgtttttttctaataaagcaagcgtacttgagggtccggtaaaggttcgcatcgagtggattttgacgtgatgtgttttagccagggttcgtagttggttcgctgcatccggccgcttggggttgattgagtaagctaaatcaaccggagtttgcgagttgacaatctcatgaatgccaaagaatagcgttgccgtggttgcaagcgtaatcagcgtcatggtgactaaaatagcaatcgaagccaatcccgcgccgttttgctgcatccggtaaagcagatttgatacgttgataaaatgtttaggtttgtaatagtagttcttgcggtgacgcagccattttaaaacgaataccgagccggacgtgaagagaccgtaagtcccgactatgacaaggacgaccgcaaagaaaaacaaactcatcgcttgaagcggattcttgacggtgaccgcaatcgtataaccggcagccagactcgcaatgctgacaatcaaagttagccacttggttttaggttcccgttccccggcgttttgttcgcgtacgagttcgatgggatgtttacgcaatagccagaactcgtcaaccaacattaaaacaatgaacaagccaatcgtgatcaacccggcaatgctaaaggcggtttgactcaagccaaaatcgagattgtgattgacatgcagcattttggccaaagtgagatagctaaggcgtgacagcacggttcccaaaatcccgccgcacaataaggttgtcagcaacagcagcagcttttccgtagccatcattttgcttaattcacgtttgccaaagccgatgatgttgtagagccccaactggcggatacgctgtttacgcaaaaagttgttggcgtagatgattaagatgacggaaatgattgcggtcgtcatcgagccaaatgaaaacagtgatttgccagctgcctgcccgaactggcggaacaaaacatcactgctcgtgtaggcgtttagcatgatcaaattaatggccatcaaaaagctagtggtgatgacaaatggcacaaataaacggcgatcggctttaaggttggtggcggctaatttgaaatagaatttcattgcgcctcgccttccttcgtcagcattgcggtcatggtttcgctgattcgggtcaaaaattcgggctgctgtaattcaccgcgatacagctgatggaaaatctgaccatcgcgaataaacaaaacacgctggctatgactggccgcaaccgcactgtgcgtcaccatgaggattgtctgcttactttcggcattgacatcggttagcaggtccaacagctcactggaggttctagaatcaagtgcgccggtgggttcgtctgccaataggatttccggctcggtgatcattgcccgagcagcggctacacgttgttgttggccaccggaaagttcatatgggtattttttcagtaaatcggtgatacctagacgcggcgccagttgggtgagccgatttttcatgatttcaagcggcttcttggctaaaactaatggcaggaaaatgttgtcctgaacgttaaaggtgtcaagcaagtcaaaatcctgaaaaataaacccgagatgttcccgccgaaatttagcccgtgcgccttctttgactttgcgcaggtcctgtcctttaaggctgatttcgccaccggtaggatcatcaagcgtggcgattaagttcagtaaggtacttttgcctgaaccggattcccccataatcgcgacaaattctcctgattcaacggaaaaactgatgttcacgagtgcctgtaccggttgggcaccgcgactggtataagtcttttcgacattttttaactttaataatgttgacataagatccgcccctttcatttatcagcttaaaagggatattgccgaaaaactacttacagtcagcgtgcgttgcttacaagctggtaaggtggcttactcggctagccagcgcgtttgcgggaagtgaatggcaaaggtgctgccgacaccgacttttgatgaaacggtcaggtgtaaccctagcttttgggcaatttgccggcttaaaaacagacctaagccacttgccttttgattggcgcgaccgttgtatccggaatagccttgttcaaaaatccgcggtagatcttctggcaggatgccgataccggtgtcagccaccagcacggcatcgcccttggcataaatccggatgctcccatgcggggtatatttgatggcattggttagtaattgctcgaaaataaatcgcagccactgactatcactcaccacagttggcaaagtttctaccgtgaccgttaagtctttggcaataaacaatttcgctaaatcccgcacggtttcgttaacaagcggttttagtggtaattcggttaacaccaaatcggtattcagtgtggtcagtttgaggtaattcagcatcacggtcagataacggttgattttaccaacttcaagccgcgcatcgctggcattgacaggttcaacctgtaataagagatccagtgcagtcagcggtgttttaatttgatgggtccacagttgcaaggtatcgaccgtttcttgttcctgatcacgatacgtgtcatgattttgacgcaaggcctgttgcagcatttggattttttgaaaataaacctgcccaagcggatcggaaatttgatcagccgcaagcagtgtgacatcgccttggagctgtgaccattcacggcgaaatcgccaaaaatcgcagccgccgatcacaagtaacggaatcagtgcaaaaaaccagctgtttaacgcgacttcaagcgaggcgttaatcagccagtttgctaacagactggcaaccagtaagatgagtaaactcagccaaaccatccagcgggcgcgcaaaaaagctttaatcatggccgccctccttattcgccaaacggtagccttttcctttgacggtttcgatcagttggttgagtcctaccggggcgacttttttgcgtaaccgattcatgttcactgccaaggcgttgcggtcaatgaactcatcgccttcccataacttctcgatcatcgcttctcgggtgaccacttcaccatcggcaccaaataacaggcttaataacttggtctctgtcggggtgaggtcaatcacttgagtcggcgagcgtagttggttgtcggtcgggaccagcgtaaactcaccgtgatttaaattggtatcggtttgctggtattggtaggttcgccgcaacatcccctgaatcttcgccaataaaaccggtagctcgatcggcttagctaaaaagtcgtccgcaccgagattcatcgccatcaccagattcatatcatccccggaactggtcaggaagataaccgggaccttgctatgtttgcgcaattcgctcagccagtggaagccattaaaatacggtaggctaatatccataatcaccagatccggtgcggcggcgcgaatttcagcgtccacctgatcgaatttttggaccaattcaaccgtaaatgcccaccgattaaggtagttaccaattgtctttgcaatcacatcgtcgtcttcaacaataaaaatcttttgcggcatgtttgttatgctcccctcgtggtgattcgtgggctttttaagtcaattgctttaaactaaagtcagcttctattttaactgatttcaggtgttaaaagtgagacaagccaaaattgggtggcaggggcaaactgccgcctttctcttaagtcaaaatttatttgtttttggaacgtccaccgtcttttttgcggtgctctgggatattgcgctaaaaacctcttccggcgcgtggatgacctatgtttcgttagcaaccgccctgccagctattttaatttcgctttcagcaggcgtcttggcggatcgctacaatcgtaaatggctgattgtgatttctgcagtcggcgtcaccgttttgaccctcgcagtagcttatgtgtttgcgtttgtgacgcaggagctatggttgttactggtcatcgcggtgattcgcagtttggggaatggtctggagaatccggcggctaacgcgttattgccgcagttggtaccggaaaagcaactgacgcgggtgaatggatataatcaaatgttgatggcggctatgctcgtgatttccccgctgctggccgggtatattttgagcgatctggggattttttggatctttgtcatcgatgcgctcacagcggtactggcagtgttgtgcttagggattgttcacgtgccaacaccggtcaccaatccggatcaaacaaccaagcagcaaaatggcattgttgccggattgcgctacgtgggtcacacgccggtattgctggcatttatgctcttcaccggactggcgtttattttaattgccccttcttcccaattatcgacattatacgtcaatcgcacattcggttcggaggtctggcatctgacgtttaacgagtggtcatggacaattggtgccgggttaggcggtttgttcattgcacggcaaaaaaagtttcgggatcagcttggtttgattgcgcttggctttgcgggcagcggaattgcatttgccgaaatgggtttgaaacagccgtttataacttatttgctatttatgtttgtctcaggaatcttttatccgctgattcaggccgggcaaactatctacttgcaggaaaatgtgcctgcggataaactcggacgggtcttttcgctgtgggcgattttgtcgaccggaatttatccgttagccatgttgggttacggaccgctggcagatcgtgtgccgatcggatggattttcattgtgaccggtttgttgttaatcgttgtcgcttatgggttctggcggcggcttaagcatctgaatgggtcatcaaataagtagcatctcttattgaaaaaagaacgctatcacggtgcagtccacaactactgccaccgtgatagcgttcttttctgacggattaaaactgccgttgaactttgaaagccgtcggaacaggtttaaagtcgactttgggataaaactgcatggctgctggggccgatagcaacatgattgaaatgttgggtccctggatggtatgcagtgtttgcaatagtgccttgcccacaccttgatgctggtggcttttgacaacagctagctcggaaacaaacgtgcaataggacttgtcagacacaccacgtaaaacgccgattaactggtgatcatcccatgcggtgagcaacacatttgcgttattaagcattcgctgcatgcgcgcacgatcttcagtcggccggtgaataccggatgcatctaaaacggcaataaactgcgaggccgagatcggctgattattttcaatatgtaacaaggcttatccctcccgaccgatacgaaacatgttgtcagcgtgtggcaaattaatgcgttcatagaaacctactgcgctgtcagccgcgcgcaatgataaagtaacccttgggccaatgtaagcttgtaacgtcgcgatcaattgccgcccaatttggtggccttcataagcgggcagaattaaaatgtcactcagatagcaacagtactcaaagtcggtcagacagcgtgcaaagccaatgagatgctcatcgtcccagacactcaagaccagttgggtttcatcaatcatcacttgtagacgggcagcatcatcgatgggcttgtcaaaatgcgtttgctgataaagatcatgaacttgttgaaccgttaagggtgcgtttactttgatggtgtacgacacaacatcagctcctttataagtttgtcaacggtcaggttaccaaaaagaccgagcagcactcggtcaaggttcattatgaaaatcatatggcaggcacgtttttcaaagtaaatagtgatgtcattgacgatttatttgaaaacagtgactttgcttgccggaatgcgataaagcgagtccggtgcattcttgggtttgccaatcgcaatcagcaaggttggcatgaagtgggccggatccaagtcaagtgccggcagaatcttttcgtgatcaaagcctgtcatcgggccggtttcatagccataagcgcgggcggccaacatcagcgacatcgcggccagactactgttttgaatgatgaattcccgcaatgcttgtttgtcctgcttgaaatcagccaccaagtgatcaatcatcggcttttggtgttccactgcccggtcagtcaacaatccggccgttgccgcgcgtttgaacaaatcgtcttcaaatggtccaaggtctaattcgccgccgataagcacgaccgccgatgcagataagatttccggtgcattggtaccggcgacactggcaattttttccttggcggcattattttgggcgaccacgaaccgggttggctgcatgttcaaggcactcggcgctttggttgcgtaagtaataatttgcagcagttcccctttactgatggtgatttcaggatcaaattcacgggcagtatgacgcttcatgacaacttcatcaaagttattgttttccaacatcaaattcacctcttagattttttagacatcttcaggatacgctatatggtggcgttttcctagttgtttttaaaatggtataggttttgatggttggaatcggttgtcttagttttgcggtgttggcattgtcaggttcaatgcccctaactgtgaaatggcagccgtcacgtgatcacccggttgcaaaaagatttgcgggtcacggcccacgcctgttccactcggtgtaccggtaaagataagatctccgggttgtagcgccacaatcccggcgagatagtgaattaaagcaggcactttaaaaatcaattgatcaagtttggcttgttgcatgatatgcccatttacggtggtcgtgatttgtaattggtcgaggtttgtgatggcatctgttgacgtcacccagggaccaatgggtgagtagttttggaaagacttggctagcgaaaattgcggttcggcattggcaaactgtacggcacgatcgctgaagtcttcgccaaccaaaaatccggcgacatgcttaagtgcatcagcctcggcaatattgcggccacctttaccgattaacacgactaattcggtttcccaatcggttttgggcccatggataggtaccgtacttgtcggaccggtcagcgagctactgaatttagtgaagacgctcggaacttcgggtaacttgatgtgaatctcttgcgaatgatcaagaaaattcattccgatagcaaaaatctgggaactagcagctaccggcgcctctaattgttccggtttaaagttaatttcagaaccgaatgttaaggtgtcgcggtgggttaaagctgtcaaaacatcggcagcattggtaatgggttgcgctgttgatgcagacgttatcagatagggatggttgtttaatttggcaattttcaaaataaatgcttcctttcagatgagccattaaccacacctttagtttacgcctgcatggtggcggttccaatcacttcagcgcatttggcccagtgagttctgcctgaaaagtttcaatgatgcgctgtaccgccgtgttttgtacctcagtgccaaacgtgacgcgcagccagccgggttttaagccatcacggacaagaaaaccttgttgtagcaggcgcttttttaaagccgatgcctgcatttttggggcctgaaagaattgaaagttggtttggctccgggtgtgtggcagtccagtttgggttaaaaagcgttcccaactatcgcgcgcttgctgcactcgcttgcgtgtcatcgcgacaaaatcttgatcagccaaggccgcctgtgcgctaacttgggcaatgctgcttaaattgtaaggcagccgaacggtttgcaagtagttaacaagttgtttaggaaaaacaccgaagccgacccggaaattcgccagtccatagatttttgaaaatgttcgcagcacgacgaggtttggaaactttgataataagctgatagcgctcgtggctggatagtcatcagtgaactcaatataagcctcatccattaaaaccagcacgtcttttggtatctgtcgcagccattcggtcagtgtcgcaattgacagcagcgtgcccgtggggttatttgggttgcacacccaaatcagtttcgttttcgcggttagcgcctgcgccattgcagataaatcaaaattgccagtttcagtgacgggcacatcaatcacggtggccccttcaatttgggcatgcaagcggtactcggaaaatgttggccatggttcaatgacttcatcccccgggctcaaaaaagtgcgggcaattaaggcaatgacttcatccagaccattgccaaaaaccaactgctctgcggcaacgtctaaatgttttgccaccgcggtgcgtagttgactggcatagccatcggggtaatcacgactttgcgtaaaattccagttggtcacggcctgctgaactttgacgctggtaccgaatgggttttcgtttgctgacatccgcaccagctgtggcaagccaagttcttcttttaatacggcaagaggcttttctggcgtatagggatgaagttgatgaatggtgggtttaaacataaacaacgcctccttgtgatcttgtttggtttggccgagcttcaaacgtgagcgctggctggcaatcggttgtcaatatttgttgattttatcgcgctcttttaagcgactcatttttccttcacggctcgccagttcagtcgcaatctgatcaagggagatgccgcgttcgaccatgagtaccagcacatgataagtcagatcggcaacttcgagtataaaagccgcatcgtcgggatttttggctgcaacaatgacctcggtgctttcctccccgactttttttaaaatcttgtccaatcctttggtgaaaagataatcggtgtatgagcctgaaactggctggcttttccgtgactggatgagatcatataattcggtaatgctttgtttggcagctgtcattgggtgcccttcctttctgtatactgacgataaaaacaactggtgtggccagtgtggcaagcgggaccagcgggattgacggtgatgagtaaggtatccgcatcacagtcaacggcgatagcttgaaccgtttgggtgttgccgctggtttcgcctttatgccatagcatgttccgactgcgcgaccaaaaccaggtttcaccggtggtcatcgttttctcaaggctttcggcattcatataggcaaccattaatacttgcttggtcgttgcgtcttgaatgacggttgtgattaaaccggacgcctttttaaaatcgagtggtatcatcgaatcgccacctttgcttgttttagaactgtcttgacttgcggtatcgttaattcgccgaagtggaagattgaagcagcgagtcccgcagaaacattcgtattacggaataaggcaacaaagtcatttgcggatccggcaccgccgcttgcaacgacaggcaccgtaacaatggagctaagttgctggtaaagtcgcaggtcaaatccttgcttggtcccatcggcatccattgaggtgatcaatagttcaccggccccggccgcaactgcttgctgagcccacgtgagcactcctagatcaactggggtacgcccgccgttaatcatcacctgataacgattccggctaggttgccaacgcgcatcaatcgcgacaacaatcgcttgacggccaaacttttcggccccggcggtaattaaatcagggtgtttgaccgccgcggaatttaaggcaattttgtcagcaccggcacgcaacaattgatgcatgtcggtcaccgaacggataccgccgccgaccgttagcggcatgaaaacctgtgtggctaccgcagcgactgtttgcgtcatggtttgccgcgcatcggtggtggcggtgatgtcaagaaagaccaattcatctgctccctgcgcctcgtaagctttggcaatcgctaccgggtcgccgacatccttaagctggataaaatgaaccccttttttgacgcgtccttggtcaacatcaaggcatggaataatgcgttttgtcagcatcgttgtcctccaattctttaagtttgttcaagggaaaactgccggtctgccaagctttaccgataacagccgcctggataccggctgtttgcaaggctgtcagatcagccaaagtgtgcacgccaccactggccacgatattgacgttaggcacggtttgatgaagcattgcgagcaatgccacgttaggacctttcatcattccgtcgcggccgatatcggttacgataaaggtagtgacgccgcgcctgaccattgcctgcattaaatgcgttggcgattgggtgcttgtggtcagccacccatcagttgcaaccttcccggcgcgggcgtcaataccaacggcaattttatcggcgccgaatttctgaacggcctgtgttaccagttcggggttggtgacagccactgatccgagaatcaagcgatcgattccggcatttagatagtgatccatgatagctaaggtacgaataccgccacctagctcgataaaagcaggtgtgtgttgccgaatcgtgctaatgacggcttgattgattggctgttgggatcgggcaccgtcgagatcaactaaatgcaagtgtttaagaccagtggcggttaaatttttcacctgagtcagcgggtcggcagtcagactgacttggcggtagtcgccttgagtgagtctgacactttgaccggctaataaatcaattgctggatagagttgcatcagtcgtcatctccttaaaacgctgtaatccggcaagccctactgcaccgcttttttccggatgaaattgcgtccccagaatattctggcgccggacgatgctcgttagcggttgaccgtagtcggtggttgccaaagtgtaggcgggttgggtctggacgtaatacgagtggacaaagtaagtcgcctggttggcaaatccggctgcgaaaggatcaggttgggtgatcgtattggtgttccaccccatgtgcggtgtcgggaatcctgctcgtggtggaattgcgaccaccgtgccagggatgaggcccagtcccgctgtttccccgaattcaaagctgcgatcgaataacaattgcattcccaggcaaatgccgagtaagggtttgccggtagccgcaaattgacggataaccggaaccaggtcgcgttgggtcaatgcagacatggcggttttaaaagctcccactcctggcaggattaaaccggctgcagccagaatgacggcaggatcagctgaaagttggttgtcaatagccagataatcaagcgcttttttgacattcaacgtgttgcccgtatcgtagtcaacgatcacaatcatgaaatcactcctttggttgagggaatccccttcactgccggattcagcgccaccgccgcctgcatgctacggcccaatgctttaaacaacgcttcaattttatgatgcgtattacgcccgtataaaacagcggcatggagattgaattcacctgcaaaggccatagcctggaaaaaatcttccgtcacttccgtatcaaatcctccgagtcgttgattggttaattcagcatcaaacacaagataagcacgcccggaaagatccaccaccacgcgggcaaggctttcatccatcggcacaaatgcgttgccaaagcgttcgatgccagctttgtcacccagcgtttgtttaaagcaacttcccaagacgatgcctgtatcttcaatcgtatgatgcggatccacgtctaaatcaccttgagctttaacgattaaaccaaagcgtccatgtttagcaaaagcatcaagcatatgatcgaagaacccaatgccggtatcaatatcaataccgctttgctggtcaaggttcaaactaatcgttatcgcggtttccttagttgtccgagtgatcgttgctgtacgcatgataaacctcctagaaaagtgagcgcgagccggcgcggttagaagtcggagtgtaagcggccttgggcgtgatggcccggttttggccattgcgaccaaggtccttacacgcagacttctgcgccggggagcgcgttatggtgagagcgcgagccagcgcggttagaagtcggagtgtaagtggccttaagcgtgatggccgggctttggccattgcgaccaaggtccttatacgcaggcttctgcgtcgggggagcgcgtcctaaaacatcatttcaactcataaaaacatgctctaacgcgtaatccgtttcaaaatcgcctccgcatgcccatccagtccttcagtttgtgccagcgtcacaattgcatctgcttgagttgccaatgccgcggcactatattgaatgaattgagtacgcttcacgaagtcataaacgcccagtggtgagaaaaatcgtgccgatccggctgttggaaaaacatgatttggcccggcaacataatcgccaactggttcggcggcattttcacctaagaaaacggaaccggcattgtgaatttcattgagataagtgattggattgggtaattgaatttccaaatgttccggggcgatggtattcattaagcaaaatgcagaagctacgtcaggaacaatcgcgataaaaccttggttggtgatcgctgcttgtgcaatcgccttacgcggcaaacttagcagttgtgagtcaaccgccttactgacggcatctgccagcgctggactagtcgtcaccaacattgcgcgcgcgtttggatcgtgctctgcttgtgacaaaaggtcagctgccacccgtaccggatctgctgaatcatcagcaataatgccgatttcggatgggccagcgatcatatcaatcgcaacatcgccaaaaacctgttttttagcttcagcaacgtagcgatttccggggcctaaaattttatcgactttgggaatactttcagtgccataagtcaatgcgccaatcgcttgggcaccgccaacctgataaatttcgtccacccctgctagttttgcggccgccaatacagctggatttaaaccttttgcttgtggcggcgttaccatgacgattttcttgacccctgcgagtttagccggaattgcggtcatcagaatcgtggagggataagccgcggtgccgcctgggacatacaaacctaccgcggctagtggcgttagtttttgaccacggataacaccgggatatgggctatcaataaagccttggctcatttctagctggtgaaaactggtgatgttttttttggcaagggttaatgctgccagtaattttggcgagagatcagccattgcggcattgatttgcgcttgtggtacgcggaggtcggagatagcaacatcatcaaaagtggcattgtaggcaagtaaagccttgtccccatttagtttgacgtctgccagaattttttggacggtggtctgcactgccggattctgggcaacggtttgctggcgggtggtcacttgttgttgaagctcggttaaggtaccggtaagaattttcatgttaagcctcctgaggacgaacttgttgtagcgactgaataagctggtaaatggccggctttttttgttttaatgctaatcgattaaccaccagatgcgttgaaacgggcgttaaagtagcaaaaatcttgaggttgttttcgcgtaaggtggtgccggtttcggtgatatcgacaatggcatctgccatccccgtgagcggcgccaattctaccgatccttcaatcttgataatctcaacatcttcaccttggttttgaaaatagcgctgagcaagatgggggtatttggtggcaatcagtttgcgtttggttttttgcggatcaaagtcgggtgttgaagccaggatgaatcggcaccggccggttttaagatcaagcatgtcaaactgctgatggccttgttcttcaaggacatctgaacccacaatcccgatatcaacggttccgcgattcaaataagtgagaacgtccgcggctttgacaagaataaagtggtagtcagggttttcggtaaaaatcaaacggcggcttttagtcgaaagtgcctggcagtcaatgcctgctgcagtgagtaatggcaaaacctgagtggtcgtgcgcccttttgccaaggcgattgtgagggtcattgcattgcctcctttggggataaatcgattaatttggcgtgatacttttgcgccatcgtcttggcttcagcaagcgaatcgactaggcaaagttgtgcgtgcggggttgtcgcaacgactgccgcggcctcttgccattgagacggacggccataaaccagtgtgagggccggtttgggatcatccggcaaaatatcggttaaggcgtccacatcaaaggccaagccgacagctggcagcaggtcttgctgaaagctggccaacagttgatcatagcgtccgccactaaacagatattgacgactatcactggcgtaggcgtggaaaaagagcccggtgtagtaagattgtggcggttggctggttaaatcaacggttatcgtgacttggggaaattgatgttgaagaaaagcaacagtttgttgtaatggctttaggcgactgtgcagtaacgttggcggcaacagttgggcaagctgagtgaaaatcgtggcagcctcaccgaacaaccatggccattgctgcaagaatgggtataacggttccgcacgtaatggcgcaatgagttgttgataggtactgagattctttttgaaaaatgctgcttgcaatgcggatgctgtcgctggatcaagtggtaatgcctgcatgacttgcgatacgaactggacatcagacaattccaaggttaggtccgttaatcccaagtcttcacagatccgggttgcttcgctcaagcaggcccattcggcttttatcgaggcgtatccgattaattcgataccggcttgtgtcatttggttataggtaccacttaagctttttcggacgcgaaaaacgtctcccacataccaccattgaacaggaggctgaatgctggtggtactcagtaaacgcgctaacggtaatgtgaggtcgggacgcatcacaaccgcctctccggcatcatctaacatttggtaaggttgttcaccgcgaaccgtcaatggctggaaaacatcacggtattccaataatggcgttttaacgcgctcataccctgaagcaatgaatcggtggctcatcatttgaatgagattttctttacgaatcgcccggggaccgaattcatcgcgggtgccgactggtaagtgtcgatttgacatagggttgctccttccgtttgcacgaagctgtggtcattaagtgatcgcgtgcacgttttgttgggaaaaatcgaaacgaattcaacaaaaaaaacgccctcgaaaacggtttttaacgttttcgagggcgaatcaacttcgcggtaccacctcaatttgtctggaccttacgacccaaacctcatctaccaatcccatgtcggcttgcgcgaactgttattggcagcggtgataacgcaacaggtgcgtgatagcttactcggttcggctatcaagttcttagatgtgtgttcagtcggtcaatcacgcgttctcagcaatcggcgctctctgtggattggtgccaacctacttggtctaatcacaacttcatggctattgatttaatgtgactctcatcataacgacattttaaaaattgtcaaccatatttttttaatgtgcggcaaaaaaatttttcaatgatcgattatttgtttttttattttggcatttttataaacaaatatacaaaaattagctaatatttgaagtctgtttgattcctaaaaaagtcagtaacagttgttgaacttctgcatcttgctttggcgttccaaagctttgacgaatccagccaggaaccatgctgtcacgcaccagataaccgtgctgtttcaggaaagtgcccagtgcttgcggatcattgacctgatagagcatgaaattggtttgtgtggcataatggcggatttggtgctgatcaaaaaattgatgccactgcttccgggcggcaaaaatctgttgttttaccttgcgtgtgaatgtctgatcttcccaggccgctaaagccgctgcctgactcatgccgctgatgttatacgggagacggacattttgcattttggggatgagtgctttaggaacaatactgaagccaactcgaaaatttgctaacccgtataatttcgagaaggttcgcatgacgagcagattgggaaactgatgagtcaacgatagcgtggatggctcgggctgattgacaaaatcgatatacgcttcgtccacgacaacgagaatgttgggcggcacctgcttcataaactgcgcgatttgatccgggggcaaataagtacctgtcggattgttggggttgcatacccagatcactttggtttttgtcgtgatgtgggctaataacgcgtcaagatcaatcaaaccggttgcggcaatcacgggggcattaatcgttgtggctccggcaatggcggcttgtaactggtactccgggtaagtcggccaaggttgtaggctctcatcgcctacttctaaaaaagtgcgacaaatcaaagcaatcatttcgtctaatccactggaaaaaagtaattgctccgctggtatgtccaaccgtttggcaaccgcggtccgcaatggcagcgcatccggatcaggataattgcgtgcctgggaaaaggcccagttttcaagcgctgcctggacctttggcgaggtaccgaccggattttcattgaatgacaagcgcgtcattttagccaaaccggccgctttggcgattctttccggggtgctgtctgagacataatccggcagcccggcaatactgttgcgtaacattacgccacctgctttcttaattgtcttagagtttacccgttatcttggaaaatgtaaatatattatgcataaatatccacatgagtgcaatcccgtctgctcattttttgcgcaatcatgttattaaaaaagccaagccagtacgcaacagaatctgctaacgatgcggactggcttggttaaagttggttattcattcgtcataaaacggcaaaaatgtgcgctttattttttagcgacaaaggcgaggtaataagtgaccgctgctactgtctgagcggaattgattttgccacttttaactccggcgactagttcgctgaatggcacgagccggctggtgacaaattcatcgggatcaaaatcctgagaagttttggccgccaaatcaagttttgccaagacgagatggacggtttcatccgtcatgccttcgcttgaacggacggcggttaaccactgcagatcatgcgtgatatagccggtttcttcgcgcagttcccggctggcggcagtttgccaatcttcaccggcatcaatcaagccggcgggcaacgcataaacttcactgttcgtcgccacgcggtattcacgattaattaacacccgattgtcatgagtcaacgccaacattgccaccgcgttagcatgccgaattaagtcacgtttaacggttaggccatcaggcgttttgattttttgcgtcacaatgtcaaaaatcgggccatgataatgcggggtctcactcaaaatagtcccctttgctaaggggtgatcaaaaaacataccgccatctcctcaatgaaaaaagccgcgctgatacgcgacttgaaattaagctttcgtaaaatctttcatccatgccaacgcaatcgccttttcgcctaaatgggtaccgacaaccgggccaaagtaagacagctcgaacggtacattcggaaatttttgctccagatcggccatccagcgctgcgcttcttccggatcgtttgcgtggattacgaccgcccgaacaggatagtcaaccttcgccaatgtttcctggaaaagtgtttcaacacgcgcgtaagctttcttgatcgaacgtatcttttcaattgcaacgattttgtgcgattgatcatcaaacgtcagtaacggtttgatcttcagcataccgccgataaaggctgatgcattgcttaaacgaccacctcgtaccagattctgcaagtcgttgacaataaagtattcacccatggttgcccgtaaatcatccaggcgcgctaatattgcttgcgggtctttgccggcttctgccatttgtgcggctgccaggaccagccagcccattaaaataacggtgatctgggaatcataaacataaactttagcaccatgaacctcatcaaccgcaccttttaaagtattcacaaacccggagattgtgctagctaagtggatactaataatggtatcgtaaccttcattagcaaggttttcatataacttcagcatttcgcccagcggcggttgcgtggtacttggaaacgttttggcagttttgagtttggcataaaattcttgtgtggtaatatctttaccttcgtcataaacttcgccgtcaagaatgaccggaatcggcaccacagtgatgtgatgttgatcaatttcggtttgcggcagataacaggtactatccgtcacgatagcaattttcatacaggcacccacttcttcaaaaatgattgtctacatcataccataaaaaaacgagttgtaagcagcgcgcaaccaggagcgctcggaaatccaagcacgtttggctgggtttggagcagttaggttcgtggctttttgagtcaagcccaaaagctttagctgattaattggacccctcaccagtttgggtagttccgcttgtttgactgccagttgtaccggtcgtatcactgctgtcattgcccgatgttgcggtgtcactggaagttgcagccgtatcatccccggtttcattagatgtggttggcggcgtggcgggcgttgtatttgaaatgcctgttgtgttaccggttgccgcgccagtttgattccagtagccatagttattgtaatagggataagtatactgagaacttgaggtgttggcactgttgttaccgtacgtattcgcagtcccagccgtgttggcattagttgaacttgtcgctgcatcgtttgttgtggtctgattggttgcaggtgtcgaagtagcgatgttgtcagcagatgtctgcgtttctgcaggttggcttcgcttttccggtgctttttgagcgatttgtttctgatacgcccgcttcaacttgctggccttttgcttaattgtttgtaaaacatcgcgattgtagacaacaaggccttgcttggtcagattagccagcaatttctcaattccatcaagtttcttttgtaagtcggtgactgagatttctttgagcgctttttttgtcagcgtattgtctttgagtaatgcgttattttggtcctgaaaatatttaacatcgcgatcgacatagctttgataacgcgccaggacttcattggtcgcgttagtctgtttggcgtaacgcttttcggctgcttttaactttttaagtgtttgcagacgttgggtgtcgtttttttgtggttgaccatactgttgcttaagattattcaaaatcacctgagttttttcggtttgttgcttttcgccttgaacgtgctggtatttgacaacgcccaataataccgccgcagcaatcaaaaccactgtaacaagcaatataatgcttcgtttacccttcatttttcccaataccctttcatgaataactttttaactgccctgccccatgctgagcaattttacgaaccagacgctgccaagagcgatcaatcccaaaatattatgcgcgaagattagaaagccgggctagcctagtcatttcggttgcactatcaaatatattctacctgttgtgacgactattgcctaccattaacagacgataattagttttgatcgaaaatggtatgtgagcgtaagccgggcgttattgacagatatctcttaattcggcatgtcacgtggcgttgacagctttgccttacgcgcctaaaaccggtaaaatgattgggacaattggaaagcgagcggatcgatatgtcttttgacggaatttttacccatgccatggcccaggagcttaataccacgttaagcggcgggcgggttgctaaaattcaacaaccttatgaaaatgaaattatcatcacgattcgagctggacgcaagaaccatcccttgttgctctcagctaatccacagtatgcgcgggtgcaaattacccacattccatttacaaatccagacgttcctgcaaccttcacgatgacgttgcggaagtattttaacgcggctacgttaacagagattcaccaagtgcaaaacgatcgggtactacactttgaattctccacgcgggatgaattgggggatgaactggggctgcgcttgatcattgaaatgatgggtcggcacagtaacatctttttagtcagcaagcgcaccggcaaaattattgatctcattcgccacgtttctgcggatcaaaatcgctatcgtccgttgatgcccggtgccccgtatgtcgagccgcctaagcaagataaagtggatccgtttcatgattcggagcggatttatcacgaacttgaacgtcaggtaacaccttcattgagtcgcgccgccttgctccagcaacattaccaaggacttgccaaggattctgcagctgaattggccctgcgactcaatcaaggcgatgccggctgggatagcttttttgcagcgctggcaacccctgaaccgactattacaacccaagggaaaaaagccgtttttaccgcgatcccgtatcagtctctgaccggcgagcagcaacattttccaaccttaagcgcgatgctggatgcctattatgcgcaaaaagcggaacatgatcgggttttgcaacaaggcgggaacctgattcatgtgatcaaaaatgtgattgataaagatcgcaaaaagcagcgcaaattaaagcgaacgctggaagaaaccgaaaaagccgatgattatcgaattcgcggcgagattctgacgacttatctgagtcaagtcaaacgcggcatgacgagtattgaactgcctaatttctatgctgataatgagccaattaagatcaccttgtccaatcaactgacgccatcacgcaacgcccagaaatattttgccaagtatacgaaattacgcaatgcagtggcgcatgttcaccagcaaatgcaggaaaaccaagaagaactcgactaccttgaaggcatcatggcgcagattgatgtagctagtccgaaagatttagtcgatattcgattggaattacagcaacaaggctatctacgtaaacagaaatccggaaaaaaaggcaataaacgccaaaaagtctccaaaccagatcaattctatgctagtgacggcactaaaatctgggtcggaaaaaacaacttacaaaatgatcagttgaccctacacaccgcgaaaaaaaccgacatttggctgcacgtcaaagatatcccgggatcacacgtgattatcgatagcagtgatcccagtgagaaaaccttgctggaagcagccaagctggcagcgtatttttccaaagcgcgcgacagtgccaatgttccggttgactggattgaggttaaaaagattcgtaaacctaatggggccaaacccggctttgtcatttacgaaggccaaaaaacagtgagtgtcacgcctgacgctgatttagtcgccaagctgcgtaacccgccgacaaaataggagatgtcttttcatgtcagaatcatccgcccaaatcagccgcccacttcaggaacatatcattgccaacaaagtcaaacatggctggaataccaccgacactaactttgaaatgctgctggcttatcatgaaatggcggaattaacgacagcgttgcttaaacatgatcaagccaatatcgctgaagaactggcagatgttaccatttacctgctgggaatcgctgaaataaaaggaattgatttagcccaggccgtgaatgacaaagtgacaatcaatgatcaccgtgtatacgatgctcaaggacacaagcatttggagtaagtatgctggccttagtgagctaagattgctgataactttaaactacaaaaaatcgaccttaagctagcatgttgattgctgctcaaggtcgattttttgattaatctgctggcactaccctatcccaaaaacttaaagacaactttactatcaaatagcttgaatgttttttcaaatagtaacttacttaaaagtgcagcggcaattggcaccgcgaaccagcacagtaagaccaagggaattgccagaccggcatctaatgaagctagtgggccaaccataccgaccataccaaaaccggctgattgtggggttccgctgactcctagcagcgcaaccggaatggcagaaacgatggcggtgaatagacacggcagtaggataatcggatgtttaaacagattgggcatcattaacttcattgcgcccagtgcaattgccagcgtcacgccggatttattgacattccaggagaaaacaaccaacgcaatagcagttgccgccacacccatggccgatgcgcctgccgaaataccgttcagttgaatggctagcccaatggcaacggttgaaatcggactgataatcaaagtagcaaacgagcagcaaattaaaatggccatgagaattggctgcaaggtggtaaagctgttgatgagttccccaatggcggttgtgaaagccgcaataaacggtagcagtaagacacctatataagccgtaccacaaccaaccagaatcggcatggccactactgccgttgaaccgaaccgatctttaatccagatcaggagaagtacagcaatcgaggcagtaatcatggtattgattaaatcgccggtacctgaacccacataggctttcagcgccggattaaacttaacgactccggagccaacaaatgccgctccagctgtcaccatcatctgcatgggattcaattcgaactgtaaggcgatcaagcccccgataatcaatggcgtggcaagttgaaaaatgacggcaatctgtgtcaacgtcaccgcaaatgtattcgtacccagatatttcagaatgccggataagacggcattgggaatgaggccgataatgacacccaaagccgtacctgataagaccttattaagaaaaactgtcaccgttaatttggaagacttttgcttggcgtgccgatcttcaaccagcccgctttctttgccggcttcttcctcagctagtgcatgtgcagcagctgttaactctttatttgccgaatctgccatgggacttcacctcttctataatgttggatctatataaatcaaaacaaccatccgcttgtgatgattgttatgagaatattaacagaagatggcatatttagtccatagttaattttgatttaatactactctcacctttttaatatacgcaaaaaaatcggatgcaagatatttttaatcttccatccgatttttaggtatcataagagtcctacttgtgcagtatcgtcacaagcttatggtcgttaaaactgttcgccccacttggccggatcttctcgccattgatgcaacgaagccaattgggcactcgtaatcgccccttgcgcttcggcggtttgaatcaaggctgtgtaattcgtcaacgtgaagaacggtagccctgctttggcgaagtttgctgtcaccgcggcgagttggtaactgaaaatcgctgcgactccgagaacgttcacgccgtctttttgcgcggcggcaacggctccaagaaccgagccaccggttgacagcaaatcatcaatgacgactaacttggcatctgcaggaaggtggccttcgatttgacgcccctgaccatggtctttcggcttactgcgaatgtaaacaagtggcagattgagtaagttggcaaccaatgcggcatggggaatgccagcagttgcaacgccaccaatggcagtcacatcaggataatgggccacaatctcttgtgctaatccagccgcgattttgctacgaacgtctgggtagccgattgtgagccgattgtcggtatagatcgggctttttagaccactcgcccaagtaaacggtgcttctggtcgtaaggtaaccgctttgatccgtaacaagtcgctggcaatttgattttctaatttagtcatgtgctgtctcccacgctttcttaattgattgataggctgcaaccgggtcatcagcttgcgtaatcgggcgaccgatgacaatagccgaactacccagacgtttagcacggcctggcgtcacgacgcgtttttgatcgcccacagcggtgccgcgcggacgaatacccggagttaccaccagaaaatcaggtttggtgacactgcgaatgagtggtgtttccaaagcactcgcaaccacgccatctgcgtcactggcctgggcgatcgctgctaatcgttgaaccgcctggctaattggcatatcaatcgataactgattctccaacatagcttgatcagtggaggttagatgggtaatggccaacatttttggtgccggatggtgggctgccttggcaccggctaataacccgcgcttggctgctaacatcatgtctttgccgccagctgcatggaccgttgtcaacgcgacccctaaccgccctaactgccacgccgccttttcaacggtattgggaatgtcgtgtagttttaagtctaaaaatatgtcgacagggtgagcggcttgaatcgctttgataacggctggcccttccgcatagaaaagttccatgccgattttgacaaataatcgttcggtttgaggaaaagcctttaaaaaatctagcgtggtagcctgatctttgaaatcgagtgcaatgatgggtgtcataccgcctgtccttcctgaatacgtgcaaattctgcggcaattttggggattgcctgttcttggtaataattagctgaaccgatggcgattgccttggcaccggctgccagcatctcggctgcatcatgaccggaactgacgccacccatcccgataatcgaaatgtgaaccgcatgcgcgacctgatagaccatctgtaacgccatcgggaatagcgccggtccggaaacgccaccggttacattggtcaaaatcggttcgccagtttcgatgtctaagcgcattccgacaaaggtattgatcaaagaaatcccatctgcacctgctgcttcaacagctttggcaatcgtagtaatgtccgttacattcggcgtcaatttaacaaagataggaacggaactagctgccttgactgcttgcgttacagcagcggccacggagggatcggttccaaacgccatgccgccttggtcgacattcgggcacgagatgttgacttccagcgcttttacatttggggcggcgcttaactttttggctactgctgcatattcagcaacatcggcgcccgcaatgctagcgataatcggtaagtctgggtaatgggacgcgagccacggcaacttttcgtgcaacacgacctcagcgccggggttttttaacccgacagcattcagcgtactgcttggcccgtcagcataaatcttgccttgattgccgattcggggcattaaagtcgttgatttggtaaccaaagcacctaatagattgagatcatattgtttggcgtaaccttcgccaaacccaaatgtcccgctggcgggcataaatgggttcttcatcgtcaaacccggtaactggatggccatgtgcgcttcctcctccgctaacctgcgtatccttttttggatcagctgatactaactgcgaatcggtgtcattgagaaggcacgcgattccaatactttcaaaatggcatcggccgtgtcaaggctcgtcattaatggcacgccatgctcaatcgcggtttcccgaatgcggaatccgtcgcttgacgcctttttatctgccgtcatagtattaatgaccagttgaatcttgcggtcggcaatgtcttcgagaatggtttctttaccactgtcaagcttttcaatcgtcgcgaccgtaatcccggcggcctcaaacgcctttgctgtgccgctggtagcaactaactggtagcctacttcacggaagcgcttagccagctcggtagcttcaactttatcggcatccttaaccgtgattaaagcgcggccaaattgtggcaagtgcatacctgctgcttcgaacgccttgtataacgcctttgccagcgttgtatcgctgcccatgacttccccggtggatttcatttccgggccaagcaggctgtcgacatgattgagtttggagaaactgaagaccggcgctttgacgtgaataccagcttgattaggcagcagaccagtcgtaaagccttgttccttcaaacttaaaccgaggatcgccaaggttgcgacttgagccagtttaacgtttgtgaccttgctcaaaaatggaacggttcgacttgcccgcgggttaacttcaatgacataagccttgccttggtgaatgataaattgaacgttcatcaaaccgatgcagtttaaagcacgcgacagtttgatggttgcatcggtaatctggtcaataatatcctgactaaatgtttgcggtggataaacggccattgaatcaccgctatgaatgccggcgcgctcaatgtgctccatgatgcccggcagtaccacggtttcaccatcggaaatacaatcgacttcgcattctttaccgactaaatagtggtcaatcaaaacgggatggtcgtgcgaaaccgataccgcgcgatcaatgtaactcgccaattcgtcagcattgtgaacgatttccattgcccggccgcctaaaacataacttgggcgaaccaaaacgggataaccaattttatcggcgactgctaaagcgccatctttgtcagtagccgtaccgccttctggttgcggtaacttaagttctttaatgacttgatcaaacaagtcgcgatcttcggcccgattaaggtcggctaccgaggtgcctaagatcttaatgccccgttttgccagcggttcggctaaattaatggcagtttggccgccaaattgaacaatgacgccttttggttgctccaggtcaatgacattcaggacatcttcaagcgtcaacggttcaaaatacagtttatccgcaattgaaaagtcggttgagacggtttcggggttgctgttcatgatgatcgcttcatacccggctttttggatcgctttaacactatgaaccgtggcataatcgaattccaccccttggccaattcggatggggccggaaccgattaccagaatgcttggtttatcgctcttggtgctttccgtgctgctttcataggtgctgtagtagtatggggtgtcgctggcaaactcgccggcacaggtatcgaccattttataaaccggcaaaatatgctgttccttacgcatctggcgaatttggtcggcgtgcaatccccagagcttggcaatttcttcgtccgcaaacccataccgttttacttcggctagtaatgataaatcagctttgtgggcggctaattcccgttccaattcaacaatgtgcttgatcttgtcgaggaaaaacggattcattttggataattccgcaacttcatcaatcgtgtaatcacgacggaaggcttcggctagataaaagagccgttcatcgttggcctgaataatgtgtttgcttagctcatcatcacttagctttgaaaattcagggcgtcgcggatgaatcaaaccgacttcaagcgaacgcaccgcttttagtaagctttcttcaagtgtgcggccaattgccatcacttcgccggttgccttcatttgggtgccgagggttcgatcaccattttcaaacttgtcaaatgggaaccgcggtaatttggtgaccacataatccagtgccggctcaaattcggcccaggttttcttggtgaccgggtttttaatttcgtcaaggtttaagccaactgcgattttagcggccattttagcgatcggataaccggttgctttagaagccaaagcacttgagcgggatacccgaggattgacttcgataacgtaatatttgaagctgttacgatcaagcgcgaattggacattgcagccaccttcgatcttcaaggcccggatgatcttgagtgccgagtcacgtaacatctggacttctttatccgtcaaggtttgagttggcgcaaagaccatcgaatcaccggtgtgcaccccgactggatcaaagttttccatgttgcagacaacgattgcggagtcggaagcatcgcgcatcacttcaaattcaatttctttgtaaccggcaatggagcgttcgattaagacttgggtgaccgggctgaggttcaggccgttttcagcaatttcggctaattctttttcgttgtcagcgataccgccgccagtgccgcccatggtgaacgctggtcgaatgataaccgggaacccgattttgtcggcaaattcctgcgcttcttggacgttattggcgatggctgattctggaaccggttcgtgcaatttttgcatcaggttcttgaacaactcgcgatcttcggcttggtcaatggcgcttaatttggttcccagcaattcgatcccaagttcgtctaaaatgccggtattgctgagcttcattgcaagattcaacccgatttggccgccgatggttggtaaaatggcatctggcaactctttgcgcaaaatctgactgacaaattcgacagttaacggttcaatatagacgcgatcagcaatttcggtatcggtcataatcgtggccggattggagtttaccaaaacaacttcatagccttcttcacgtaatgcgagacaggcttgcgttcctgagtaatcaaattctgcggcttgaccgatgataattgggccagagccgatcactaagattttatgaatatcttgacgttttggcatgattatcctttctgcgtacgatctgagaatgcatccatcatttccataaattcatcaaaaagatggtcggcgtcgtgtggacccggcgcagcatccggatggaattggacggtgaaagccggatacaggcgatgccgcaacccttctaccgtgccatcgttaatttccacgtgggtgaccagcaaggtgtccgggtcaatgctgtcaggatcgacggcgtaaccgtggttttgactggtgaaatcaatgcggccggttgcaatttcacgaaccggatgattgaacccgcggtggccgtatttcattttgaaggtatcggcgccatttgccagtgcaaataactggtggccaagacaaatcccgaatagtggaatcttaccttcaatgccacgaatcatatccaatgcttccggcacatctttcggatccccagggccattggttaacatgacgccatccggtgctaattcaagaatggtggctgcagtggttgtggacggcaacacggtcacattacattgacgtttagccagttcccgtaaaatgctatgtttgaggccaaagtcaatgaccaccacattgcggccagttcccggtgccggataagcctgctgagtcgagacttgttgtacttgattctttggcagtaccaatgctttgagctggtcaaaggcatgttcgtcggcggcatccacaatactggctttcatggcgccgacttcccggatctttttggtcagcgcccgggtgtcaacgccgctgataccgggaatatgtttgcgcttgagaaattcatccagcgtcatctgactacgccaattaccggtgacccgcgcaacgtcccggaccacaatcccctttgcagtcggatcaatgctttcgtaatcatcacggttaataccgacattgccgatgagcggttgcgtgaatgtaatgatttggccattgtaactttgatccgtaatggtttcttgatagccgctcatgccggtgttaaaaacaatttcaccagtcgtgaccgtttccgcaccaaagccgacgccaggaaaaacactgccgtcttccagaattaaatagcgcttcatgcttgtcctcccttttgataggcgatttggccgtgactaatggtatataacgcctggccttgcacctcttcaccgataaatggtgaatttttaccttttgaaaaccaatcggcgggatcgattttataagaagtttccagatccaaaatggttaaatcggcgggcccaccaactgtgatgtgaccacctggcagtccgaatttggctgccggaatcgtgctcattttggcaatcagttgttggagcgtgaacattttggatttaacgaacttggtgtacagcagtggaaaggccgtttccgaaccgacgatcccgaatgcggcggttttaaacgatcccgtcttttcttcagccgtgtggggtgcgtgatccgtggcaatcatgtctagtgtgccgtcttgcaagccttccagtaatgccaaatgatcagcccgtgaacgtaacggtggattcattttaaacatggggttatcgccggggatgttattttcatcaagtaacaaatgatgcggtgagacttcagcggtcacgttgacgccgcgtttcttggcttcgcgaatcaaggccacactttggcgggttgagatatgacaggcgtgataatgaacgcctgtggcagctgccaggtctaagtcccgagctaattgactgctttcggtttggttaatgatgccaggcaggttcaattttttggcaaccggaccggcgttgatcacgccaccgtgcatgaggcttgcgtcttcaatgtgagccacaatcggcgcgtttaacttggctgcctgtagcatggctcgatacatggtgtcagcatcttgcaccccgacaccgtcattggagaagccaagtgcaccggctgcttgtaaggcgggcatgtcaaccacttgatccgagtgcaggtcccgtgtaatgggggcaaactggcgaacggtgattttggcatcgctacgattcttggccagtaacggcttcaaagtggcaactgtatccggcaccgggtttaaattactcatggcgacaacagttgtaaacccaccatgtgctgctgcctgcgcaccggttttaatggtttctttcgcggtaaaaccgggttcgcgaaaatgaacatgaacgtcaatcaatcctggcacaactgtcgcaccggtggcatcaatcaccgtttcatcggctcgagctgtcagttgctggccgattgccgtgatctgctcgccggtgatctgaatatcggcagtgtattcggtgtcgctaacgatgtgggcatttttgatgagcatgagttactcctctccgaagtgacgggcattgatgaccgcttccagcatggccattcgcatgaagacgccattttgcatttgcgtaaagatccgtgatcgtggtccgtcaactaaatcactggctaattcaacatcacggttaaccggtgccgggtgcatgaaaatggcattgggtttcatggttttagccaagtcatcggtaatgccatacttagcatgataactttctttagaaaaggcttcgcgattatcctgattgaagcgttctaactgaacccgcagcagcatcaacacatcgacctgtttaaccaactccggcacgctgatgaagtcgccataacggtcaaagctaggatcataccactgttgcggaccagcaaaatgtaacgtagcaccaagtttgtgcagcatctgcatatcactgcgggcaacccgactgtggctaaggtcgccgacgatcccgatgctcaaaccttcaaaatgaccgaattcttcgtgaatggtcatcagatccagcatcatctgggaaggatgttgccctgcaccgtcacctgcattcacaatggcggttgttggccaggcacccatgagttctttataatagccgtcttttgcgtgccgcatcaccgcaatattgacgccgattgccccaatggttttaatggtatcttccagcgtttcgccttttgatactgaactgtgggccgggtcgaacgggatgacggttagccctagtttgcgttcggccatttcaaaactggtatgcgtacgggtgctattttcaaaaaataaattagcagcataaattggttccggaaaatgaacggtttggccggctttgaagtcttcggcgcggttgattaacgccatggcacttttttcatcaacttgttcagcggaaacaaaatctttaaacggtgtatctgtcagattagataaggtcatttttctctgccccttcttcattagcggcatgttctggtaaaacaaagttcaggaagattccgatcacggttgccagtgcaaggccggaaaattgatagccggcaaattgcaggctggcattgccgatgccgatcacaagaatggtcgaggcaatcatcaggttgcgcttcttatcgaagtcgactttgttgtcaattaaaacccgtaagccattggaagcaatcaccccgaacagcaggaaactaatgccgccaataaccggacttgggatgctacgaattaatgcgcttagcttaccgatgaaggcgaacaaaatcgcgaacaatcctgcaccgcctaagacataaacactgtgtaccttcgtcatggcaagcacaccgatattttcgccataactggtgacaggcgggcccccgacgaatccagcgatgattgacgcagttccgtcaccggctaaggtatggttcaagccgggatccttaaagaaatcacgcttagtcaatttgttgagtaccatgatgtggcccatatgttcggtcatcgtgacaaacgcaatcggtgccatggataaaatggctccccagtaaagttgcggctgatagctgataaaaggcagttcaaactttggcagatcaaaccaggccgcttgttgtaccggcgtcagatcaacaatgccaaacagcaaggccaccacatagccggtgacaattccgagtaagatcggcaaaagactaataaactttttgagatacatgttgtaaatgatgacggatgccaaggtgatcatcgcaacggcaaagtatcgcaggtcataaacgctcttggtggcactgattgtacgcatggtcgcatcggtggcggctgtgcctgccaaggataagccaatgaccatgacaatcggaccgaccacgattggcgggagtgcccgatcaatccaagctgatccgctgcgagcaacaatcaaggcaacgatgagataaacgacaccgactgctacggttccttgtgcgatggctggataacccgcacctttcatcaaagcttgcatgatcgtgataaacgagaaactcgatcccatgtacgcaggaatcttaccacgagtaatcaggatataaactaaggtgccgacaccgcttgaaaataaggcaatgcttggatccagtccgactaaaatcggtaccagcacagttgaaccgaacatggcaaaaaggtgctggattgaaagtcccacccattgaccgaatttcggcttatcaccgatatccagtactgcttcgtcattatgaaaagccattgattattcccccatcttttcgatgctgatgccgtctttgccatcaagttcggccacctgcacctgaatttgctcgtcaagtgaggttggaatgtttttaccgacaaaatccggtcgaattggcaactcgcgatgtccgcgatcgacaagcacggccaagctgatcttacgtggccgaccttcatccatcaacgcatctaaagcggcgcgaatggtgcggccggtgaagatgacatcatcgactaaaatgacatgcttgccggtgatattaaccggtaactgtgctccttcaacatctggttggtgttcatggtcgattttatggacatcatcgcgataaaaccggatatccaattcgccaaccggaacttttaaaccttctagttgttcgaggcgtttggcgatgcggtgggccaaataaatgccacgggttttgatcccgactagaacaagatcgttcaaacccttattttgttcgatgatttcataactgattcgtgtcaatgcgcgtttcatagttacctcgtctacaacctgttttgactgtgccattgatgtgccaccctttcttgtatgtatgctgataaaacttggtgccagtgagtttgcttggtgatgaaagctgtgctccgacttctaaccaggctggttcacgctcggtcataacgcgttcaccagcccagaaacctgcacataaggaccttggtcgcaatggccaaagcccggccatcacgcccgaggccacttatgctccggtttctaaccgggctggttcacgctcactttctataacgcgctccccggcgcagaagtctgcgtgtaaggacctcagtcgcaatgaccaaagcccggccatcacgcctgaggccacttacactccgacttctaatcgcgccggttcacgctcaacaaaaaacgcctcctacccaatttggatagaaggcgaccgtagcctgaataatccgccgcaacggaaaggaaaccttctaagcctcactggacttagttaaaggtgcttgttcgattgagttaagattaccgaacgttgcgggtcttgtcaatgcctgcacgcagatcggttaaggttttttcaaaaattggcggtaccggcgcggtaaaagttaataattttcccgtgaccggatgcacgaagccgagttttgccgcgtgaagaaactgaccatgaccaggaagggtacgcttagggccatagagaggatcgcctgctaccgggtgatgggtgtaagccatgtgtacgcgaatctgatgcgtgcgcccggtatccagaatgcattttaccaaggtgtagtttgtaaagcgctccagtacttgaaaatgggtcacagcatggcggccatctgcgaccactgcttggcgtttgcgatcgcgcgggtcccgacccaacggcgcatcaattgtgccctcgtcttctttaaaagtaccatgaaccagtgccaaatattcccgaatcgacgttttagccttaagctgggcggatagacttagctgggcggcttctgtttttgcaaccattagcaagccgctcgtatctttatcaatacgatgaacgattccaggccgaatgacgccattaatgccaggtagcttggtgtgatacagcaacccattcaccagcgtgccgtccggatgacccggtgccggatgaacaaccatgccttgaggtttgttaaccacaatgacttgatcgtcttcgtaaacaatctcgagtggaatcggttcagcaacggccttaagtggtttaacttccggaatggtcactgtaacaacatcaccggccgtcaccttaaaattagctttcacgggattgccattaacggtgaccaagccgtcttggagccatttttgcacctggctgcgggtgtgggtggtctcgtgggccgtgatgatcttatcaattcggccgctttcggtggtaatggtgaaggtatcgctcatgctaccgccgccttgtcacgatcaaacagaatgtagatcaagacgaaaataaccccaagtgtgatgcagacatctgcaaaattaaaaatcgcattaaaacgccactgatcaagaaattcgagatggaacatatccgttacatatcgaaaacgcaaacgatcaataaagtttccaatcgcccccgctgtgatcaaggtcaaccccatccgataaaacggtttatgcagactatcgcgccacagcatggcaacaacaacaaacgctagaatcgtagtaacgtaaaaaaaccactgcttaccttcaaacatcgaaaaagcagcaccagtattacggatatgggtgagatcaatcacacctggaattaatgactgactgtcaccaagcggaatatgaaccctaacccaagtcttaatcccaaaatcaagcaaaaccaagacagcagcaaccatgacataaataagcaaagaaaaatcctcctgagcgcgagccagcgcggttagaagtcggagtgtaagtggccttgagcgtgatggcccggttttggccattgcgctcaaggtccttacacgcagacttctgcgctggggagcgcgttatgatgtgagcgcgagccggcgcggttagggatcggagtataagtggccttggccattgcgaccaaggtccttatactccgatccctgcgccggggagcgcgttatgatataagcatcagctgactcctacctcagccgcgcatctaatgtttgcttcctagtgtaccgcgcccaaagaaaaaccgccatcttgaaaatggcggttaacgtttatcgtagcgatggcctcattagaaaagtccggaaatcttaccatcgtcggtaacatccatgtttaaagcagctggtgcttttggtaagcctggcattgtcaaaaccgtgccggtcatgacgaccaggaacccggcgcctagcttagggataatatcgcgcacatgaatggtgaagccttcaggagcgcctagtgttttagggttatcggttaacgaatactgggttttagccatgcaaatcggtaagtcctgccaaccgttcttagcgatggttcgaagtgcagcatttgctttaccttcatagacaacatcggccccgccataaatcttttgaacaatggtcttgattttttctttgacgtcgctgttgcgatcataaagcggtgtgaagtgacttggctgattcaaagcatctaaaactgcatccgcaactgccaaaccgccgcggccaccatctgcccaaaccgttgcagtgaccgccttgacattgagtttggcacaggcatcaattaaccactggatttcggcatcggtgtcacttgtgaaccgattgaccgcaacgacaaccggcacaccgtaaccttgcatactgtggatatggcgtttcagattggcaaaacctttagctaacgcgtccaggttttcctgttgcagatcggctaatgcaaccccgccgttatacttcagtgcgcgaacggttgcgacgatgacaacagcatccggggttttacctaacacgggggtcttgatatccatgaacttttcaccgcccagatcagcgccgaagccagcttccgtaatcgcgatgttacccagttgcaaagcggtgcgggttgctaaaacggaattacaaccatgtgcgatgttggcaaatgggccaccatgaataaatgctggcgtatgttcaagtgtctgtactaagttaggcttcagggcatcgcgcaataacatggcaatggcaccggtgacttttaaatcgccgaccgtgacgggtttgcggtcataggtatacccaatcacaatccggccaattcttgcttttagatcggcaatgttttcggccagacatagaacggccattaattcgctggcgaccgtaatgtcaaacccatcttcgcgcggcacgccactggttggaccgcctaagccaattgttacatggcgcagtgcccggtcgttgatatccaacgcacgcttccacaaaattcggcgagggtcaatattgagtgtgtttccttgctgcagatgattgtcgattaaagcggccagtgtgtcgacggcagtggtcaaagcatgcatgtcaccggtgaaatgtaagttaatatcttccatcggtaccacttgcgcatagccgccaccggttgcgccgcctttcattcccatgaccggacctaacgaaggttcccgcaatgcgataacaggatgctggccgcgttgttgcaaagcatcacctaagccgacagtaatggttgatttgccttcaccggcgggggtcggattgatggatgtgaccaaaacgagcttgccaaacggcttatctttcaacgcattaagcgccgtaaagctgagtttggcttttgatttgccataaagttccaaatcgtcagcggttaaaccgatacttgcggcaactttcgtgattggccacattgagctggcttcgttagcctgggcaatttcaatatcagacatacaacacactccttatttagtggatgtttccaaacgttttttgatcaacgccacgattttttgttttcgctttttgccgaacatcagaaacgaaacgcgaccgtattgtttggttttaagcataacggtcaaacggccattcgtaaagtcctcaatgtccgcccaagctaaattaatcgtgttacttttaaaaaagctggttaaacgaaggcctttgggcgttgcgactaggcggagcaataagatttgaacaatcgcaactaaaattgtgacgcctgcaaccgcgaccgccagccatgataaactggtgctttccagctgaagaatgatcgctaaactaagtccaaatacgatcgcgctccaaaacatgctaaaatcgatccatgcaggttgataatgtgttcgatatcctgccaatttgccacttccttaggagaaatcatgcttaaactatacacagatggcgctacaaaaggcaacccgggaccggctggcatcggcattctggttagcggattgcctcagcaaattcaacatcatgccgctttacctgcgatgagcaaccacgaagcggaatttgctgctgccattgccgggtttaaattattgattgaatccagcttgacaacaggcacagtcgcttactacagcgattccaagttagtgattcaagccattgaaaagcgctatgccaaacactatccggcgttaacggcagagctgctgagcttaattgacgagtttccgctggtattacccaactggatcccggatcggcaaaatcgcggtgcccatcacctggctcaacaaggtttgcaccaagccgaaactgaaagttagtgtcagtcatcttgtcgtttcatggatcgattgacgtaaaaaaaagcctgaaactccagcaatattggaagtttcaggctttttgatcgaaacgtaccagcttgggttatagctgattatttaagaactttgaattgttgctcacgatccatgtaatccttggcatttgcttcgccttcgatggagccgaatggcatctgagcacgtaactgccagtttgccgggatatcaaaagcttcgcggacaaggtcgtcaatgatcgggttgtaatgctgcaggttagcaccgataccgttgttagccagcgttacccacgtgttaagctgagctgatccttgagactgttctgcccaagttgcaaagttatcggcatacagcgggaaatttttctctaactgttttacgacatcggtgtcagtgaagtataaaatggttgcaaaagcggctttaaaaccggcaatttttttcttggttgcctcgtaggcttcctcgcttggcacttcactctttaagcgcttgaccacaatgtcccataatttatcatgttgctcgccaaacaggaaaacggcccgagtagcctgtgagttaaaggctgttggtgtttcttgaataacggattcgattaatgcaaccaactcgtcaggattttgtttgatatccttgccgagtgcatagatggagcggcgttgtttgagcagatttagaagatcttgattcacgagataaccacctttttattattaatcaatacgtgttcgggcacacaccgtcaaaaccacccttacctatcactggctgtgaacgttaaaggcggggcaacgcatgtgagaacaagcataagtttaccaactgactattagtaagtaaacccccaagcgaaaatttcttgaaaaagcgactggctaaacttgcaatggtataccgaattctgcttagcgcttctatactataacgtgacagtgaccgttggcttgggtacaataaaattattcttcatggaggtgcggtatgtcgctcattacgtggctaattattattattttggttttgaataccattggggcgattttcaccgtcctccgcgaagtccgcgatatctcaacgacctgggcttggttacttgtgctgatcttcctgccgattattggttttggtttttatctatttgccggtcgcggcttgtcaaccaagaagttgcggcggattcaacgcgaatatgaatctggcgtgaaagccttcgtgtcacttcaaaaacatgaaaatgcgcgcaataagctattgccgcctacggattacacgccagcagctaaggcgttaacggccttttttcttaatacggcccaagcaccggtacttgcgcacaaccaggttcaactttacacggatggcgaaaaaaagtttgcggcgttatttcgtgatatcgaagcggctaaacattatatctatgttgagtattacaccatttataacgacgagctgggtaatcagtttcaacaactacttataaaaaaagccaagcaaggtgtgaccgtgaaggttttgtatgatgcctggggttcaatgggtgcctcggctaaatggtggcggcggctcactgatgtcggcggacaggcagaaagctattttagctcgaaacatcccatcaccgactttcggcttaactatcgcgatcaccgcaagatcgttgtgattgatgatcacgttggctatattggcggttttaatgtcggtgatcaatatgtttcgcgcaaaccgaaattcggttactggcgcgatacacatttacgcattgtcgggaacaccatttatgcgttgaaaattcgctttacaatggattggaacgcaactgtcgataagcaaaaagaaattgcctataacgtcgaacaaagcggtgccgaggatctgaccagcgaaagtatgaccgcaggcagcacgccgattcaaattgttgcatccggacctgaccgccccacccaacaaatcaagctggggtacaccaagttaatcactagcgctaccaaatcagtttggattcagagcccctatctggtgccagatgatacggtaatcgatgctttagtctcggcggcgatgtccggcattgatgtccgaattatggtgccggatatgccggatcatccctttattttccgcgctacgcaatattatgccaattatctggcgcgatcaggggttaaaatttatcactaccagcacggtttcatgcacgccaaaaccgttgtcgtcgatgatgcgattgccagtgttggctcggcaaattttgatatccgcagtttcaaattgaacttcgaaataaatgcgtttatttacgatcgcaaaattgccggaactttggccgaaatcttccaagcggatatggccaaaagctatctactgacaccggaaatcatttcgaaccaaggctggtggttacggtttaagcaagacttttccaggctcctgtcccctattctttaaattgcttcaaaagcctttcattataacgcgctcaccggcgcagaagtctgcatgtaaggaccaccccttaagcgcaatggccaaaacccggccatcacgcttaaggccacttacacttcgtcttctaaacgcgccggttcatgctcactttctataaggcgcaaatgataacaacgccggttcaacgatgtgatgcttcgttgaaccggcgttgctttttgaaaaatggctgatgaagataccgcgattaaataaaattgttaccgaaaaggactaaagccatctactgaacgacaccccgcgcttggagactttcagggccgcgcgcattaacgctgccaatcatccaataccttggtgtgaccaagaagataatgaatcgcagcatgaactaactcgtcgcgtgccgccaataactcatcgccctcaagattatacttatcgcgcaaataaccctctgcaatcgcttgatattctttgcgcgcctcgccgccatcgtttaaataagtatcaatcgcttccagattatctttggcccgattagccagttcttcggccagatcatcaacatgcggctgacgtttgtgagcgtaatccatcagcgtgtcattcatatcaatgacggccgcttcatcagctttcttgtcacgtttcatggttacttcatctcctaatactattagtatgcacctatgacctattttcatcaacgctgagcgcgaaccggcgcggttagaaaccggaacataagtggcctcagtcgcagacttctgcgccggtgagcgcgttatagtgtgatcccgtcttatattttccgattgttctgccagcaacaaagtaacggccaccgattaacgatgcaagagctggcgggagcggtggaacaattcttgataaagtgccgaccagctctcgaacctgtcactcgctaaataaaaaacaggcgtgtctggtacaatcggttcctcaccgggagccagcgcctgagcagaaatcacaaggtccgggtgttgggcaacagttaccagtcgaatataggcgggatgcatcagattaaggcggactgtttcgtacaaaggttgtggcatcatgggatcaagtgccactttgagtttatcggaaacggcactgtctgtcataaatggccaaagtaactgatagaatccgtcaacgatttcaggccgggatttttcagttggaagctcccgggcaaaaaaggccttaatagctgtctccagacgcggataaaacgcgcgcatgggactggcggttttggttaaatcaatgtaagcgccgcctggaaagatgcgttcgctaattaaaatttttaacaagttacccgccaaggcgagatcattggtcacggatggtgaaattccgacgagtcgtgtgctgagttcggcgcgaatcttagcgaccgtttgccatgctggcgtctcgttagcggcatgatagccgaccaaggtggcagcatcaaattgttgttccgtatgaaagcgtggaatccgccattgtccgagataaagatagagcatctcggcttcagcagtggctcgtggcaagtttgctaaaggagcaggtatttttttaggtaatgatggctgcggtttgagcgcagaaaagttcaaagtaccggcaattgagtggtgggccttaaggcgatgcaaattaatattggctgaaaatagcaactgggcgaccgagaaatcgcgttgtaccatgccggccgcttgcaacgctttgatgagttggcgcgactcaggcaaaatatcggcgaacaacggattcccgatatcgaccagttgccacaataattggcgatagatttggcgaattcgcggttcagaaccgatcagcgataacggggttaaattaatcgaaacttcggctcggcgcaaatagagtcgtaatgcggaaattcggcgaaaaaaagcagcgcgggaaaacccggtttcagtcaatagatctgaaagcgttgacgtgggcgccatcaaagttttgacaagtagtttccccggcagtgaccgccgatataaaaagatgcgataacgaacacgactgatggcaggcggtgccgtcatattgttatcaccgcggcgcaataacggcggtgcagcaggatcaatttcatgcaaatcagcggctaccttctccatgagtcggcgaagttgccgataactttcgccgcgcgccattgaggtagtcacaatgttaagctggtggttgggtgcgtcgcgtaaagtgccgtaaatcgctaaccggtctcgttcttcgcggtctagaaaaatttcttcaaacgccatggtgccgccttctttttcaaactttgctatagtatagcaaatggcgattgtaaactagctaaataatgcctgcttgaggccacccctattttgaatcatttttgccgctcattcaaagtcctcaaagtagcgaccacgttggcgtgatggttattagcaatatttaacgcgtccttttaccggttgccactggcgtttactatgcaatcttggtatactaaaagtaagcaaaaatcggatcgacaccatatgctcgggggcatcaaaaaaattaaccccaagatatggtgtttttcattgacaggcaccccaatattgagtattctaaaagacataagataacaagaaaggatgatacctatgcgtaacatcacactgtttacgcgcaatggctgtccgcaatgccggatgacaaagcgctacctcgatacccataacatttcatttaccgaacacaatatcaacgaagaacctgaatacatcgactacttgaagaaaaagggattccagcaggttcccgttctcgaagcagatgggcttgattcattctccgggttccgaccggatgccttgaagcaactggctgtttgatcagccagtttttttatcgcatcgaaactagcaaggaagattaaatgcagcgaaagcagggattagcatgtcactaaaaaccattagtccggatgaggttacttattacgcacttaacaacgagattaacattcccgttaacgaccaaattccgcttaacaaagataaagaagcattgcaggcctttttgaccgaaaatgttgcacccaataccatgaaatttgcttcattacaggagcgcttaaagtatctggttgaacatcactattatgaagccgactttttaaagaaatatcaaccagcctttttggagaagttgaatcagtttctcactgcccagcatttccaatttaagtcgttcatggctgcgtataaatattatgctcagtacgcgttaaaaaccgatgacggaacgcaatatcttgaagattacaaagatcgcgttttcgctaatgcccttttctttgcggatggtaacgaagatttggccgttgacttagccgatgagatgattcatcagcgctatcagccggctaccccatccttcctgaatgcaggtcgggcgcggcgtggtgaactggtctcttgtttcctgttgcaaatcaccgatgacatgaattcaattggccgggcaatcaactcggctttggaactttcccgtatcggcggcggtgtcggcttgacactgtcgaacctgcgtgaagccggtgcaccgatcaagggcattgacggtgctgccagtggtgtcttgccggtcatgaagttgctggaagattcattctcctacagtaaccagctgggtcagcgccaaggtgccggggttgtttatttgaacgtcttccatccggatatcatcagcttcctaggcgctaagaaggaaaatgccgatgaaaagtatcgggtgaaaacgttgagccttggtgtgattgtgccagataaatactacgaactcatcaaggctaacgctgacatgtacctcttctccccttattcagtcgaacgcgcgtatggcaagccattttcttacgtggatatcacgaaggaatacgacaagatggtagccaatcctgatattaagaaatacaagattaaagcgcgcgacttggaaaacgagatctccaagttgcagcaagaatccggctatccatacatcattaatatcgatacagccaatcgtgccaatccgatcgaaggtaagattatcatgagcaacctgtgttctgagattatgcaggttcaggttccgtctaagctcaataatcgtcaggagtacgaggtcttagggacagatgtttcatgcaacctggggagtacgaatattcctaacctgatgcacagccgtgattttggtcatagcgtcgaagccatggtacgcgcgctcacttatgtcacggatcacagcaacattgacgttgtgccgtccgtgcagcacggcaatcaccttgctcacagcattggtcttggtgcgatgggcctgcatacctattttgccaagaaccacatgtattatggttcaccggaaagcctggatttcactaacatctacttcctactgcttaattactacacgctcaaagcttccaataagatcgctaaggaacgcggcgaatccttccacaactttgaaaatagcaagtacgcagatggcagttattttgacaagtatctcaatcaaacttgggcgccgaagtacgataaagttcgcgacttgttcaaaaacattcacattccaacgcaggctgattggcaggcacttaaagaagatgtgatgaaaaacggtttgtaccatcaaaaccggatggcagttgcacctaatggctcaattagctatatcaacgacaccagcgcttcattgcagccaattgtcaaccggattgaggatcgtcaggaaaagaaaatcggtaccatttattacccggcaccgggactgtccaatgatacgatgccttactatcaaagcgcctatgacattgatatgcgtaaagtgatcgatgtttatgccgctgcgcaacaacatgttgaccaaggaatggcgatgacgttgtttatgcgcagtaccatcccagccggactttatccgtggaaagatggacgcacgaataaaatgactacccgggacttgaacatcttgcggaattacgctcattataagggcattaagtccatttactacatccggacttataccgatgaccaagaagaaatcggcagcaacgcttgtgaaagttgctcaatttgataatcttttaacagggggatctcccctgtttttacataaggagcgaagaaaatggcaaaacagtatattgcgattaactggaatgcaattgaagatgaagtagataaagccacttgggaaaaattaaccgaacagttttggctcgacacccgaatccccttgtccaacgatttggacgattggcgttcattgagtccggatgaacaatgggtcgttggccacgttttcggcgggctgactttactggataccctgcaaagtcaagacggtatggcaagtttacgccaaaacatccggacccaacaggaaaccgcggtgcttaataatattcagtttatggaaagtgtccatgcgaagagttattcatcaattttctcgacgctgaacacgcctgccgagatcgatgaaatctttgactggaccaatcacaatgagcatttgcagtacaaggccaacaaaatcaatgacatctatcacaacggctcggcactacaaaagaaaattgccagtgttttcctggaaacgttcctgttttattcaggcttctttaccccgctttattacctgggcaacaacaagctgacgaatgtggcggaaattatcaagctgattattcgggatgaaagtgttcacggaacctatatcggctataaattccagttaggcttcaatgaattgccggaagcagagcaacaacaactgcaggattggatgtacgatctgttatacgacctttatgaaaacgaagaaaagtatacgaacgatctctacgctaaaaccaaatggaccgatgaagttttgactttcctgcgttataacgccaataaggccctgatgaatctgggacaggaaaccgcctttccggataccgccgatgacgttaatccgattgtgatgaacggtatttcaacatcaacggctaaccatgatttcttctcacaggtcggtaatggttaccgtctcggtcaggtcgaagcaatggaagacgatgattattcattctcgactgaagataaagggcacaaggattaaaatgaccttgctcatgacagcaaaacagcctttgcagacaattagttatgtctcaaaggctgtttttgtttgcctgaaatcgtgtaaatgctggcgccaattctgataaatgacgcgtagaatggtgaccggcttttgcttataacctgaccacgagattagggttcggttttatcagacgcaatcttttcgtggacaagttccaaaaagtgttgcgcgatacgcgaaagctcccgatcccgtttccagaccaacgcaaccggatcggctagtgcaggcgctaacggacgaaaagttaaggaggtattagacgtttgggtagccagatattccaggcacaatgcccgccccaaaccgactgctgtcatgcctaatgcatcagcagttaagtcataagttccgacaatataggctggatccaatccctggccaagccaatgttcaaaactattgcggatgtgcgttgctcgtggcaggatcagttcactgtcactgatatcatttggcgtaattaacaggttatcagtaaggggatcgtcggtgtccatcaagattccccacgcatcacgcatgggtaacaacaaccgttcatattgcgtatgctctttacccggacgcagaataaagtcatacatgccggcttccaggttagctaccagactttcatctgatccatacgtcacgtggacatgtaagctgggatactgaagccgcaaagattgcgctaactggagcatgagttgtttgccgctagtttcgcctgcaccgatatagagatcaccgcccaaggcatgtttgccttgtaaattatttttggtccgttcggcaatggcggtcaattcgcgtgctcgatttagtagataggtaccatcttcggtcaaggtgacgcggcgattaccccgaatgagcaacttgacgcccagctctttttccagatccttgagctggcgcgatagccctggctgagatatacctaatgttctggctgcagcggtaatactgccatgatctgcaatttcaatgaagttgcgcaacgtctgcagttccatgttctcccctacttcctatcagtcctaattatcacaagtgctttcctataacaattatagcccattagcggcactttgtattccctttcacacatcatcctttatcttggccagtgttcgctcacctaatccgcttgaccgtgaagatgatactttgatccaaaaaagcatcggctcaagtgagccgatgcggatggtgctaccagatttgaacgcgtttttccggcggtaagtacatgccatcgcctggttgaacatcaaaagttgtataccaatcatctaaattgcgcggttggatgttggcccgtaattcatggggtgcgtggacatcgactgctaacaacatcttggcgcgctctaaacgagacttcgaacgccaaatgcgcgcccaattgatgaagaatgcgcgtaaatcagcatccttttcccgtttagccgtatccaacgccgctgctaatccgccggcatcggcaatattttccgaaaccactaatttgccgtttactttgccggctgccgtttccagaccgtcaaattcgtcaatcatggcttgggtcaattcatggaagtgatcaaaatcggctttttgccaccagttggccatgttgccgtactcatcgaactgggcaccattgttgtcgaatccatgagaaatttcgtgcgcaatgaccgcgccaatcccgccaagattttccgaagcggtttgctttaaggaataaaatggtgcctgtagaatggcggctgggaaagtaatgtcgtttttggacggatcatagctggcattcaccaagtgtccgggcatgttccataccgtgcgatcaacgggtttcgtcagtttatcaaagttatactgtacttgcaccttgcgcatggcaaataagttttctagcaatgagcgattgggatcaacatggagcagatcgtaaatggcttcaggatgatccggataccccatttttaataccatcttatttaacttaagaatggctttgtctttcgttggctgagatagccagtcagagttagctaagcgctgtttgtaagttgcaatcatcttttcaactagctgggtgacatcggcttttgctttttccccaaagtaggtccgcccataataaatgccaattggttcgctgaagtaccggttggcgacccgataagcatgcttaagctgatcaggcgatttcggtgcaccagataatgcgcggttatatgtaccgctcaattgccgcaatggttcgctcaagaagccggccacgtcacctagcgtcatgacataaagccagtcgcgataaagcttgaagttggcttcattaaataactggtcaaattcattcaaaaagcgcggatccgcaacaacaattgtttccggcacattcttgaaaatcgtctttaagaggttttcaaaattaaacggcttgagcttctcaatgaccgtgctagttggcgttgggttataggccttaggataatcggcccattcttcagaactcttgacgtgcttggcaatttcggcatcaaacgccaacgcgccttccaaagtggccttttgtgcggcttcgtccaaatcagtgtacgccaacagttgctgcatcatgtctttgaaaatgccaagcaattgcgcgccattttgattgtccttagcgtaataagacgtatccggcaaaatcgtttttggccccatcagattaatcacatttttgctggtatctttcatgtcggcatcaacaaaaaagttgaatggcggatcgattaaatgctcctgaagcaaattagcagcgcgttggttgtaatccgccaggtctttaatgcccttcaccaggtttaagcgcggttcagccggggcaaatccggcagcgtcccgcgttttaaagtccttagcctgttgatacagcgttactgcctgggcaaaatacttgtcaggtgcctgctttttgccatctgaaaccgcggcaaagtcagccatcatcttctcctcgacttcatcggcaagatcctgaaacccgccggtactacttttgtcgtcaggaataaccgcttgtttcatccaagcaccgttcactgcttgatataaatcgtcttgatagcgtacttcacttgtcattaaaaagctcctttcaccatgaaacgttatgtcataatcttaacgcacttctcattttcttgcacgactgattcacgtttcagtgcaataggacgcaataaattctaatttggccttaggtttttctcttttaatgaaagcgtgccgagtattaaagtcggcgggacaaaattggatcgcacagcgagttagattggcaaaatagattgttgtcaatcgaaatcgctttctttttggcgcataactcgttaaaataggccatgtactaagtcaacgatcgactaatcgtgtcagtcgttactggataacgcgtttgctggcacctgctgaagctgtcagccgatgctcataggaggatgtgcaaggatgtattatgtcattatgaagtctcacgatattcgtgaaaacttggcgactgagcaatatctgatgaatgccaagcagtttgatgaaccactgctgcttttttattatgaaaagccaagcgtgattgtcggccgtaaccagaacacgctggaagagttgaatcaaaagtatgttgaagatcacaatatcgttgtgacacgtcggctttccggcggcggcgcagtgtatcacgatttgggtaatttatgtttttcatttgtggtcgatagtaactccgaagaatttggtgatttcaagtccttcacgcagccgattgttgatgcgattcacacgctgggtgcgacaagtgccgaagtttcaggtcgcaatgacatgctggttgacgggaagaagttttccggcagcgcaatgtatacccgcaacggtaagacattttcgcatggcactttgatgctggatgtcgatatgagcgtcatccctaatgtgctcaacgttcctgaagataaaatcaagagtaaaggaattaaatccgttaagagtcgggttacaaacttgcggccttatctggataaaaaatatcagaatctgacggtgccggaattccgggatattttattgacccgtctgttcggtgttgacgatgtggccgccattaaagataaggaataccatgtgacgccagaagatgaagttgagattaaaaagatttatgacgatgtttataataactgggattgggtttacggtcatagcccagagttcaccactaagaaacgtaagcactttgattatgggacgatcgatgcgcggtttgacgtgaaagatggcaaaattgccaacgttaaattttacggtgatttcttcggcccacaggatgttagtgatgttgcggcagctttaaaagacaaaccgtacacatctgaagcggttaagaaaactttagatgcaattgatacaaacgcttatttcaccaacatccctaaagaagacgtcattaatttattagttccttaagcacattcagacttatttttctataaaaaggggcagccatttgtcggctgcccctttttgatcattcttgcaaacaatcaattatatttaacctggctaattgcatatgcctggattcgtttggctccccgcccagtttcaacggtaatgacaccgcgttcgttataaggcttaacggttgcagcctcgatatcaacgacgcgaccctttaagcgatggcgatcaattgtgttaattgccacctcctgttgcgtgtgcaaagcatcttgaagcaagttggtaatttcttctgggcgttgtgccataagaattcctccttcatcttaatggttagcatgcgtccatccagctaacagcatggatcaaggaaagttgcgctgcgaatttccttgaaactggctcttgctgacagacgtattcggttggggatactgtcgcaatctgatttgcaatcggcgtcacttaaaacgcgcgattgaaaacgattacgattccagtataacgattctgcggcaaaatttcagtagccgcggctaagatcaacttggtgactggctaactgaccgcttgctatcaaggattggaggttatcattaaaaattttaaaaacctgatcacgcagatgtggcacggtgccggaaatgtgcggcgtcaataaaacattgtccatgtcccaaagtggcgaatcttgtggtaacggttcaggatcaacgacatccaaggctgcggctcgtaactgctgggtctgaagtgcctgaaccaacgccggtgtatcgaccgaagcaccgcggccaatattgataaacaacggctgattttgaagcccggaaaagaattctgaattataaaaatgcttggtggcagaagttaatggcaatgcattaataaggatatcggcgttttgagcggctgtgtgtgcgttagcgtctgtaacgacttcctcaaacccggcagcaggacggccgtgtgcactcacgccaagcgtatgcagacccagtgcatgtaattttgtcgcaatcgttgagccgatatggccagtgccaaaaatgaccgcggtttggccttttaacaacgtcattggcggccgttgctgacggaaagtccacatctggcgaccggcgcgaaccggtggtagaatgccgcggctgatcgtaaataacacgccaaggacatattcagcaatcggttcggcatgaataccactcgtgtttgccaataatacctgatgtttagcaaagtcagccagcggtagataatcgactccggcagaaatagcctgaacaaagcgcaggtgatcgaaattcacttgcgcagattgatcgtgccatccataaacaacgtcaatttgctgggcggttgcttgatctaactgattgtcgtcaatcaccacgtgccctgctttttctaagacttgtcgttgctcaggtttgagattaaaactatttaaaattttcaaggtgtgcctccttacttgttatgatgccagttaggcttgccccagtattggaaaagatcggttcgaatggtgccattgtacaactttcgccgtttggttgcttgactgccatatgctttttcaaatcccatatcactggtcaaaatgtacttgctccaagtcgtcaacggcgcaaaggcttggcccatttccttgtaaagttggcgcaccatggcctgatcgctaagccgcttcccataaggcgggttggcaacaatgaccccgttttccttggtggtgctaaaatccttgacggctaattgcttaaagcgaatgctatgcagtaagcccgcttgttgcgcattcagcttagccatatcaatcatatcgccattaatgtcactagcctgaatatccagctcacggtcaaaatcggcggcgtccatcgcctgatccttggttgtttgcaagacggattgatcaaaaaagccgaaatcttcaaacgcaaagtgtcgttgtaatcccggtgccagatgatggccaatcaaagcggcttcaattgcaatcgtgccagatccggtcgtgggatcgacaaacggcatatcaggatgccagttcgtcaataagacaagcgctgcagcaaagttttccttcagtggcgcctcgccttttgcaatccggtaaccacgtttgaacaaactaggtccggttgtatctagcgtcagggttgcaacgtcttttagaatggagacttccagtggataagtagcgccggtttccggcaatcgcgtggttcgatgatagactgcggacatcttttcgacaattgcctttttggtgatggcttgaacatcgggctcagaatgcagttgggaacgaacagcccgccctgcaactgggaacgcagcgtctaacggcaaaaagttatcccacggtaatgccttaacgccttcaaataaatcgtcgaaggtgcgcgctttaaactgaccgatgacaattttgatccgatcagcgctgcgcaaccagacattggtcaacgcaatcgtttggtcattaccctcaaaatagactttgccattttcggtgcgggtttgaatacccaatgccttcagttctttcgtggtaaccgactcaaggccagccgccattgttgcgacaagttgatagttcatagcatgagttcctttcaaaattgtgagacgagattagtcattcaaggttagtttaactttttatgtacgttatggcgattgttgaggggcataactttatcgttgcggttaaggttgaggttgagtttggatggtggtttaggcgtggatggtcagaaagtgttcgggctttggctaatggaagtgactgttggccgatgctgctcataaacgcgctcacaggcccagaaacctgcacataaggactttgacccctaaatggccaaagaaagtttagacattggtcagtgaaatagaagttggccgatgctgctcataaacgcgctcctcagcgcagaagtctgcgtgtaaggaccttgagactaaatggccaaagaccagccatttagtctcaaggccacttacactccgacttctaaccgcgctggctcgcgctctcaaaaaaacagcccgggtttccccgggctgtgcctgcatgtagatccctataagccatgttttgttccagaacctgttcaggcgcgggttccttcagtcatcatctatctcagcgttgccgctgtattgccgtcgcttcagtttgcttggcaaaacgcccctaccaaaagtttgggttactcgctcgcggggtttacccgttccaccgttcaggtttccctgaacgtttcgtcactgtggcacttttcagacctactgacgcataaccgaagtcttagcgtggttggccgccgtaaccgttctcacggtccctaagcttattgggcttagcacgaacactacaagcatcgcagcttgtgcgggcatggactttcctcagcctgcagatgcagaccgcgatcactcaggatctacatgtgatcattaatactggtcaacgtcggaatggttgctgtcgtcgcggttatcaacactgccgctatctgacagttttgaaccgaaaacatgccgttccaaattactcagacgtttaagaatatcataatttgttgccgcagcattggtttgcggtgtttgtgcgctgacattcttggaaacactcagctgtttggtcagctcatcgacccggctaaacagctttgcattttcttctttcaaccgatcaatttcattggtgaaagcttcatagtcacgaatgatgccgtctaagaattcatcgacttcatccggatcatagccacgaaccttgtttttgaacttcttgtccaaaatatctttaggcccgtactggatactaaattttgtttctttgttactatccattccgacacacctcattgttttcatggaaccagactactaattagcttaccatatctcaatcattttgaaaatgctcattttcagcttcggccaattcttcggatgtttcttgtaaatcatccatcgtaatcagtgttaccggataatcacgtcgattagccatgtcttcggcggcacggtaatcccactgcggttttccgggaaattccggatcatagacaatcaccgccgcatctgtgtgtgccgtcataaaccgcgtataaccttgaagttgggcgggcttttgataaggtgcttgtgagactgcatcagagaaatcaacttgctggcgtaacgcagccagttgggccttattgttgtcattccactgactaccaaaatcggtaaatggcaacatcatcgcaattttaaacccaggatagagcggtttaagtgttaaggcaacttcgactgaccactgttcaacccccagttgaccgcctgtaatcagccaattgagcccttcgtcaagaaactgggtcagtgtgttttttaatgaagttttaaggactttcagttttggatcctgagccccaaaaacattgagctcataggcacggtaaccagttatccataacctttttcctgccatgatttccctccaatcattaggccaacgcgcttgatattggtataatagcgccaggagtgtgatcgcatgaccattcgttatcccaatggtaatccatacaaagacgggacgcaattttcaccagacgcagtgtcgcgccctaccatttatggcggacgcgggatgactttagaagaagaacttaacctcagcaatcagtattatcgtagtatcgacaaggccgttgtctataagaagccgacgccagtgcagattgtgaaggttgactatcctcgccgaagtcaggcagttatccgtgaagcctattttaagacgccttccacaactgattataatggtgtgtatcgcgggtattatcttgactttgaagccaaagaaaccaaaaataagaccagttttccgttaaaaaatttccaccaacatcagattgatcattttcggcgttgcttaaaacaaaacggtatctgttttgttgtgattcggtttgcaacgattaggcggctgtttgttttcccggcaggacggctcattacctgctgggatcagcaaagcgtaggcggtcgtaaatcgattcctctaaccaagatcattcaacacggatttgaacttcatccgcaattgcagccagttgtcccattccttgatggcgttgactggctgatagaaacgaaagtaggtaatgtacgtggctaataaccaaaacatgtcgcgaatggcacgacgccgcgaagataaacagtcaaaaagccctaaaccccccaagaaattatggcggcggattttaaaatggaccttgctcggtttgcttctcattttcattgctggtgtcgggttattctcctggtatgcaaaagatgcacctgaagtcacccaagcaaaactcgaatctggcggatccagtacgatttatgatcgtagcggtaatgagattacaacgcttgggctggaaaatcgcgactatgtcaaagcttcggagattccgcaacaacttaaagatgcggttgtttcaattgaagatcgccgcttttacgatgagaaattgggcattgatcctgtccgtattctcggtgctgcttttaacaacatgaccggaaccggtgacggcttgcaaggtggctcgacgttgacacaacagctcattaaactatctgttttcagcacaaaatcgtctgatcaaacattacgccgaaaagctcaggaagcctggctagccatgcaggttcaacaaaagtacagtaaagatcagattcttgaatattatattaataaagtgttcatgaattatggtcagtacgggatgagcactggggctaagttttattttaataaatcgctcaaagatctgagtcttgcacaaacggctttcatcgccggcctgccgcaaagtccggctggctacgacccttatgagtacccgcaaaaagcgactcagcggcgtaatgcagtcattgatgccatgttacgcgataagaaaattacggctgctgccgccaagcaagctaaagccacaccgattactgatggtttacagccaaaacaacaacagacaaacacaaccaccaatgataaagtgattgattcttacttgacgcaggtgattgcagaagttaagaagaaaaccggcttgaatccttacacggacaatttggatatttacaccaatattgacatgagtgcccaaaaacggctctacgatatcgtcaataccgatgattatgtcagtttcccggatgatgcctttcagaccggcgtcacgatgacagatccggataacggacaggtcttagcgcaaattggcggccgtaaaaccggcgatgtgcggttagcatacaaccgggcagcgcaaaatacccgtagtaatggatcgacaatgaagccgctcatggattatggtcctgctattgaatatcttaactattcgacttatgaacaaatgacggatgaaccatacaagtatcctgggaccacgatttcgttatatgactgggacaagaagtatcaaggtcggatttccatgcggacggcgcttgagcagtcccgcaacattccagccgtcaaaaccttgagtgcagtcggtatgacgaatgccgtgaagttcttaaagggactgggtatcgacttacctgcctcagaacaatatctttccagtgcgatcggggcatcggtcaacacggttgaagaagccggagcgtatggggcctttgccaatggcggcacttattacaagccttattacgtcaataaagtcgttagcgccgatggcaacacccaaacatttaacagtcaaggaacccgggcgatgaagtccagtaccgcttatatgatcacggatatgctaaaaggcgtgttgacaaaaggaacaggaacatcggcggctatttccggcctttaccaagctggtaagactgggacgaccgattatagcgatgaagagctcaagcagaatccggccctaaacgctacaggcattgccaaggacgcatggtttacgggctatacccgcaatcgggtcatttcagtctggaccggttatgataagccgacttctcatgggatcagttatgctgagcaaaccgtttcccagaagatctataaggcactgatgagttatacctcccagaaccttgataataaggattggacaaagccggatacagttgagtcgtacaatattctaaaaggcagcaatcccggcacagcgattacgagtggctcagccaacaccacgaaggagttgtacgttcgtggtcatggaccaagcagtcataaagcagtggctgaatcatcatcttcttccagtgccagctctgaatccagttcctcaaaagaatccagctcagaaagttcaaatgctgtttccgccagcatcgcgtcacatgcgacatcttccagtgtttcttctactgcgcctagttccgcagcaccttcaaaagaagaaacaagttccagcagtgagcctgtctcatctgctggtggtcctggtggtaatcaataagatttattcacgtgatttgaccatcaagagttttccctgatgaggattgccggacatcattaaaaaagcaccgctaccgatttgagatggtcagtagcggtgctttttatatgtgaaactaagcttgctgttctagatgaaccacggccacatggtgctgtgccaataacgtttcgccatacggatcattgcgatagtcatgcgcatacacaacacgcttaatgccagcctggatcaaggcctttgtacaattcagacatgggaaaaagttaacgtagacggttgcgccatgggtactgaccccattagccgcacattgaatgatggcattcatttcggcatgtatggtccgaatgcagtgaccatcacgcattaaatgaccggcctcatcacaatgcggatcaccactaatcgcgccgttataaccggtcgcaatgatccgatgttcctgaaccaaaactgcccccaccgttgcgcgctcacaagttgaacgttctgaaacctttttggcgagttcaagaaaataatgatcccagctttcacggtgaaccgtacgcttggatggcataatggcatctgtcaatgttcttccccctttaatggcgcgtaatgggtagccagaaacgtccattccggtccggatggtggctgtgggtctcgcgcgcgtaaatgttcacggccgaatcgaatcaaactgcggtgaagtttgatccaggtcgattttggcatcaaagtttcaagtcggctttggatttgaaccggtgttgctttaggtgaaaccaggcccaatcctttcacaatgcgactaacatgagtatcaactgccacgcccggtatgccaaaagcatcgctgaggaccacagtggcggtttttttaccaactcctggtaatttgaccaagtcagctgcattggctggcacctgaccgtcatatttttcaactaaaatagcactcaacgcttttaaatgcgccgctttagttcgatataaaccaagacgactgatttttttggcaatatcggtgactgaagcagcagccattgccgcgggcgttggatacgcggcaaatagttcgggcgtaaccgcattaacggctacatccgttgtttgcgccgaaagcatcactgccactagaatctgaaaaggattttgcgcgtgtaatgtcggctgtgggtcaggatacaacgccataatttgctcgaacaattgtcgggcttctgaatcagtcacacaggttcccccttttaaaatcggtttgattatgattccggtactgcctaatagttaaagttcttgatgacgcttgagctcggcttgaacctgttgcgcggttttaagatgccgtcgttcccaattcagcaaaatgcgatccatgtacttcagtgaatacgcggcattcaaaacggcttcacgtagcgccaataagattacttctggcaagtagtgatccgtcgttaaccagtcgcgaatcgtttcctgttcaattggtgaaagtggtcggccaaattcaatttcaatttgattaaagacattcgtttgcgcatcggcatttggttgggacattacgctgctatggcttttttggtttgtcggtatcttcgccagcaacggcgtgagatcatagtggtcgcgcattttaccctgaccatccggaatgctttcaagaacaatcgcctgtttttgaatcaacgtttcaattgctgtatagattgcattgggtgcgacgttcatgcgcgctgccaatgccttaagatcaggggcttgatgatgcttggattgccactgatcaatgaacagatacgttataaactcggtttgggtcagtcctaacgtaggatagtcatcaaacagcagattagaaacattaaactgtcccgcttcgatgtaccgttttaaatcagtcatgataggaatcctccaaaaaaagccggcgcgttggcgtccgacttttggttgccattacggctttaggcgattgatcattcgtgggaatgggatggcttcgcgtaaatgatccaacttgcaaatccaggtaatggcgcgttcaaggcccaaaccaaatccggaatgcggtactgaaccgtacttgcgtaaatccagataccattcgtattcatctaaatcaaggccggccttttcaatggcagctttgagcttgtcataatcggtttcacgttccgaaccgccgatgatttcgccgtaaccttctggtgctagcatatcggcgcagacatattgctgctcatcttccgggtccgttaacatgtagaacggtttgatggctttaggataattcaacacaaagacaggctgatcaaattgatctgacagatacgtttcttccggcgagccaaaatcatcaccgtatttgacgtccatccctgctgcctgcaacatttcgattgcctttttgtagctgatgcgtggatatggcagcttcgtatactttttgagtacttccggatcgcggcctagcaaatgtaacggataggcgcagttatccaataccgcctgcaccatataggcaacataacgctcttgaacttttaaactctcttcttgatggcaaaacgccatttccggttcgatcatccaaaactcggtcaaatgccggcgggtcttacttttttctgcccgaaataccggtccgcacgtgaagactttaccataggccattgcccctgcttcagcatacaactgaccggattggctaagataagctttcttgtcaaaatagtcagtttcaaaaagttcggttgtgccttcaggtgccgaatcagtcaagatcggcgggtccattttgataaagccttcattgttaaagaattcaaacgtggcgcgaatcatttcgttacgaatttgttgaatcgcaaattggcgctttgatcgtaaccaaagatggcggtgatcgagcaggaactcaatgccatgctctttaggcgtaatcggatagtcgtgtgaatccccgacaagctcaatgttgcggacttcgatttcgtagccaaaatgactgcggctatcttggtgaatgacgccggtgatccacatgctggactcttgacgtaattcctttgccagctgaaagacctcatctggcacgtcggctttagaaacaacgccttgaaaatacgcggaaccatcgcgtaactgtagaaaggcaatctttccggagctgcgtttatcggttaaccacgccccaattgttacttcttcgttcacatgttcttttgcatcaataatgcgaatcttttccgtcatgcgttaactccccacttcaataattatttaccaacaaactcccggatacgccgggcggcctctttcagactggccaaatctttacaataactaatccgcgcatgatccggcatgccaaacgcccgtccaggaacaatggcaaccccggtttcggtcaacagtgcactgataaaatcatcaaccgtaccataatgactcaattgagcggcacgcttaatattcgggaaaagatagaaggcgccttgcggtttatctcccatatcgaaaccgggaatatctgccagaagatcatagaaaagattcagccgttcttcaaaagcacggcgcatcttttcaacaacctgctgatcgccagttaaagctgccaccgcggcgtattcggaaactgctgccggattagaggtcgtgtggctaataaaggtcgccatggcctgaatcagcttttccggaccggccgcataaccaatccgccaacccgtcatcgcatatgacttggagacgccggaaattaaaacagtattcgctgcgatatcgggatcgatactaatcattgaggtgtaagtcgtaccgttataaatcagatctcggtaaatatcgtcagtcactaccaaaatatgatgcttcagcgcccaattgccaattaaggtcagttccgtgcgatcatagacaacgccacttgggttttgtggcgaattgataatcaatgcccgggttttatcggtccgagccgcctcaagatcatcgacactgactttatgtccgactgccggcatgaccagatgtggcacgccgctcgccaatttaatctgttcctcgtaggaaacccagtatggaacaggaatcagcacctcatcgcctgggtttaagaaaacctgaaataaggcatacaaagcaaacttagcgccggtggttgcaacgatttgacgatgatcataacgaataccgtcttgggcaaatatccggtcactaatcgcctgctttaattccggaataccggttgctgccgtatagaaactggcattaccagcctgaatcgccgcaatagctgcgtcatcaatcgccttaggggttgaaaaatctggttggccaatagacaaatcaatgacgtcggcaccttttgcctttaagtctttcgtctgattacttaaggccaatgtcgctgacggtgcgacgttgaggattctttttgctaaatgcacgactgcgcctcctacagcttcggcaccattgcggctaccgaatcatttttaattataaatttttgatcgcgttcaattgttcgccgctgcgaaaactgtacgtcacgtagttcagtttaccagactttgacagatagccaatatcccagacaaattccgatcctcttttacccagtgatgcattcagaattttcttgggagcgctggtttgggtcacctgttgaatggctttttgccgggtaataccggacttttggtttaaaatcgttaccttgcctgtctttttctgaatcacgacgtaaaccgactgattcttcttggtttgaccggcaacggtgagataactcttatcacggttgtaccaccagaagccgttcacgttttttaaatcagcccgattggtagcaattttttccgcttggtcgcgcaattgttggtaaggtgacagactcttggcataaattccgatggcagcgatgatgagaacaatcaggccaccgataaataagaatttggcccagtcgaaacgacggtgatgacgcatcggtgctcccctccttttgttgggtatggttggttgagaattaggtgatgataagccaatgctgttcgtgaacgcgctcacaggcctagaaacctgcgcataggggtcttgattccaaatggccaaagtgtggtaaactcgggcaactttttggtgtgttgaccgatacctttcgtaaacgcgctcataggcccagaaacctgcacataaggaccttgattccaaatggccaaaacccggccatttggaatcaaggccacttatgttccggtttctaaacgggcctgttcgcgctcttgcttcttaaccacattctaatgtaccccggaatatcggtgagtggcaatgtcattggtttaatatttggtaaggatttttgcattttcttaccatacgcggtggtgatgaagcgtggatcgaggatgatgaaggcgccgcggtcggtttcggtgcggatgaggcggccgaagctttgacgcagccgcaagatcgcacgcggtagggcatcttctgtgaacggatcgccgccgcttaattgaatctgacggtatcgggctttggtgatcggcgcttcaggcgcatcaaagggcaaccgcgttaaaatgacgatttcaagcagtcgatcgggataatcaatgccttcaaaaaagcttgctgcccctaagagtaaactttgctcgccaactgcaaaccgtttggcaattttttccgctgaaccggtgacaccttgagccaatagctctttgtgcccggcaattggtcgatggatcaaacgttggtagacggcctcaatgacggataaagaattaaataagacaatcgtttgatattgattatccgccagttgttcaatggccatcgctaaataatcagcgtaggcatcatccgagacgtccgcggcatgaggagcatctgttgccactaaaaccttggcctgatcgcgataatgaaatggactgcggagttttaagaagctggattccggtaattcgtgatagcctaattgggcagttagaaaatcaaatgaacgctcagccgtcaaggtggcaccgacgaatactggcgcttcaaaatgatgaatcagttgctgaacggcagatccgacttggaaaacatcccaacttaattccagactcgccacatcggtaatctggcgtaaattaacggacataatcaccgcctgcccggcaattaaatccggcaaccggcttagtaactcttgaagaagctgacgatgatctgccaaggcgattcgcagcgctgctaacgcttgaaactgctgcccatcgctttttaagaagaaatgcggtcggcggttaaaatcagcggttaatttgtcagttgtgaccgtcagcctcccaagaactttaatgagcgatttgatggtggccgtttgtgtctgttcgagccacttggccgctgctgaatccaaacttaagttcacaaaacctgaagctgcagttgttttgccaaagaagaagtggcgatggatctgacgctgcaaggtattcacagccgtctcggcagtggctgcctgttgattcagttgctgtaacaccgttagcatggcaggttcactttgataaatcgctgtcaatgaatgccgttcgtctggttcactcaattgccatacacgatgcaactgatgatttaagtggtcaagcgccacccgccgtgcaaacgcggcagcagtattgtcggcaaagtgctgcgcctcatcgactactagaaatggccgtttaaatggtaacgtgtctgcatgccgtgaaagaaacgcgtggtttgttaccaccaccactgcatcagccagtttagcctgcagccgccgataaaaatcgaacgtataaaaaggattgatgaatggcgtgccaacatcaccggaatgccggatttcagcaaacaacggcgcgcgataagtggttaaatgcagctcatctaaatcccctgtcgttgtttgagtcagccataccagtaatttcatttgcaacagttgggtttggcgagtcggtccttcttggtgaagactagcagcaaatttattgagatcaagataatgctggggacttttcagctcaaccgtgggtaacgtgcgcccaagcaaggcatcaagttcgggaatggcttgcgttatcagctgcgtttgcaaaaccagggttgacgttgccacaaccaacttttgctcaggtgtggcaaggtaagcataaggcagtaaatagcccaatgtcttccccaagccagtccctgcttcgatgaataatggtatttcggttttttgcgcatgcgtgaaaatggcatccatcatcttggcctgtgctttacgaaagcgatagcgcggctgtagcagatgttttttggctagttcggttgctggataagcgccagccgttgccaaatcggttggtgtagtcgtcggccgacgtaacaccaatggcccgacctgaacaaattctttttttaacggtctggggggtgacgcgatcattttcagataatcaccggtttcgcgaataaagccatcgtgacgctgaatcaaggcctgttgcgttggtgtcggtaaggcctgaaagcgcgcctttagttgcaacagtagtttcgcggtactggtagcgtcactatcggcttgatgcgggttgtcatgttggatcgcaaaatgagtcgtcaaatcactgagtcgaaaactgctgatttctggaagtaacacctgtgccaactcaacagtatcaatcgcctcaagctgtaattttggtaaaccgatacgctcaaactctgcatttagaaacggataatcaaaattaacattgtgcgccacaaagaccgtcttagttagcacttggtgaagcgcgggcgctacctcatcaaaatacggcgccgcgactaaccgttcagggctgattccggtcaaccgctggatcgtctgcgggactgaccgatccgggttgatcatttgtgaaattgtttgaatgatcttgccatggcgcaccaaagcacaaccgaattgaatcatacggtcgccgtccttgacactggttccggttgtttccaaatcaaccacagcaaaagtggtgtcagcattcatgaacttttaaccattcctgtctaaacatactgcatctatcatactatttccctgttgactctgctactaaatccacaatcgttcctgttcgtaacaagaccagataacgatgggtaaccggcttgggttgaagttgcgtcaaggcctgagcgtataagttcagttggccacgataacgcgccactaattttgccggatcgggctcgtgatcggttttatagtcaaacaacgtgacaccatcggcctcagttacataaccgtccatgatcccgtgaaccaaaacatcctcgccggggtcattttgtaaaatctcaaacaactgattggcaggcaacaacatggaaaacggcacttcccgttgcacctgttgcggcttagcttgcaataactgtcctagatcggttgcaaaaaagcgcaccaaagcagttaggtcaatccgcttggcaacctctgtcggcatgaccccggtggttatcaagtggtgtcgcaaggcttctagactgtttagcgtaatcggtttggtcaggtcaaccaattggagcaataaatgcgtcgccgttccaatcgcagcagcattcccaccaccgtaagtttcggtcaaaaatgccggcgcacctaaatcgtgtagcggcggtttcggccctaaaaatcggtcggcactcactagttccatcgtatccggatcgtcaaaagcccgcttgatttccgaaacactttgaaagcctgccgttgtcgtggcagcttggaatggatactgcgtggcaaaccatcctgtcagctcaattgccggtgcatctgttttggctggcgttttggtcgccgctccgactttaatttgcggatgggtctcgattgcaatcgaaaactcggttggatcagctaccaaggccggtttgacggtggtttcagtcagtcctttgacttgcggatgacgaatgagggccggtccgatccaatccagataattcgttgccgccccgcgaatttgcggtgcaagcgtgagctgttcaccttccgcggccttggcccacttggcaaccgttttgtcagccgaagttaattgctgcccgctcatggttgcgccaacaacatagaggcgttgctgggcacgcgtcaacgccacatacaaaagacgcatttcttcagccaatgtttgattttgtcgagcggctttggcggcttggtattgcggtaactcatattccacccgggtttgcgggtcaagccacttaataccgatcccatttttagtcaaaattgccggtccgctttgatcgcgacggttaaagtgtttgttcgtttgtaagacaaaaacaaccggaaactcaagccctttactcttgtgaatcgtcatcaatttgacggcatcgttatccggatcaacctgagccggtgtggcaaggtcctgatcctgcttttgcatcaaggtaatgaaatgaatgaaggcaaacaaacctttaaagccgccagattcataagtccgagcacgatcaaccaaggcaagtaaatttgcctggcgttgactgccgccaggggtgccgccaacataatcgagaaagccggtttcctgataaattgcccacaacaatgtcacgagatcattttcccgggccagatcgcgaaaatgattgagttggtccaaaaatgtggtcaacgtggcgtgagtgcgtttagccagcggcgttgtcggtgttccggtgagaaaagcggtcaccgcgtcataataaggtacttgtttggctgccaatcgaatcaaggctaactgatcagctgagaggccgacaatcggcgagcgcaaaaccgcaactaacggaatatcttgcttaggattatcgatgattttgaggagtgccagcatcaccatcaattccgtcgtcttgaagaaattcttggtatcagccacgaataatggtacgccggctgcggcaaattgggtttgaatgaggctgttttgggtggtttggcgtgttaaaagcgtaatatcgcgataccggatacgccgatattgctggttggcacgatcccataattgtgcatcgggatcctgaactaaccgctggatctcggcaatgaccatttgtgtttgaccggttgcaacatccagcggctcgtcatcttcatcggttgcagaccagtccgaagtcgcgttggtttcgtcatcatcgtccgaagtcgctttgctatatagcatgactttgaccgctgggtggcaatcgccataatcaagcgcaccatactttaacgcagcattgtcgtcataagccaaatcgccgacttcaggatccataatctggctaaaaataagattggtgaacgccaaaacatttttagtcgagcgaaaattttctgccaaaataatccgttcaggcgcggtgggtgtttccggatgacttgcaaacgcctgatatttttgaatgaataactgcgggtcagctaagcgaaatccatagatactttgcttcacatccccgaccataaagcgatcgccggggtcggttgtgctgacggctgccagtaacgcttcttgtaaggggctaatgtcttgatactcgtcgaccatcacctcatcgaaactggcgcgataattgtcagcaatcggtgcgccggtttggggatctttttgctgcaggattcgcagtgcgttatgcgcaatatcgctatagtcttgcacatgccgaaccgccttttctgcggtcagcgcatctaaaaaggttaaggccacctccgtcagcatggtcatcatcggttgcactgtgtggagtaagtcggtgatttgctcacttgttaaggcaaaatccggtgctaactgatcctgccatatttttttagcggcatcccgctgttgtttagcctcatttttgagtgctttgtcgtcgtcgtcaagacctttgctggcgcgagaccacgctaaaaagtcatgctgaactaagaccccgcgaaccgcttcatagctcggcttggggttgtctaataaactttgtaacgggttcaaatcggctgtgatttgttgatgccagactggatttggcaagcggttggccagctcatccgcttgcgtcagcgtggtgatcacttgcatgagtttgcgtttggttcgcggccaaatctggtgcgtgaaggtcgccgcccaagcttctggtgcataaggctttgccagttgttgcaagtaagctttgggatcggttgtggcagcagcttggcgcattaactcgaacattaaatcctgaaggccactatcatcccgatcgccgctaaagttagcggtcaattgctcgaattccgccgcttcgtcaccagcataaaattgttcgcgcaaatcgttccaaacctgttcttgcaacatatagcgttcagtttcatcggtcagtaaccgaaaacccggatccaaatcgatgacatagtaataagtttggacgatttgcaaactaaaagcatccaacgtactgattttagccgcgtttaccatggcaatctggttggccagatggcgccgatcctcagcatttaactcatgtcgcttggcggtcagtgtttgcttcaaggcagtctgaatcttagtccgcatttccgaagttgccgctcgcgtaaaagtcacgatcaacattctggtaatatcggcgtgctgcttgagaatcttttgaataatccgttcaactaatacagtggtcttgccgctgccagccgaggctgataccaacatatcatggccgtgatggttaatagctgcttgttgcgatggggtaaattgcgtcatgactgtggatgctccttttcagaatgcggtatttgtgtcgggtcagcggtaaggcgtccaatcacgtctttacgctttaacttagggacgtgatggtaatgatcaaaaccggttgcagggtcaaacagcataatactttgatagtcgctgcgactgacaatcgtggaagactggccatattggaaaggctcaagtgcaatatcccccgcaagaatttgcgtggctgcatcgataatcagcgcctgattgtgagccaaataagcccgcaacgcctcgggagtcaggacgtttgactgattctggttgaaactgccatcttttttaaagccaagcggggcaatctcactacgaccgccactttccggtgaaatggtacgatccacggccgccagctcatctccgtgtt
